United States Patent 12,569,549 (FLAVIVIRUS VACCINE) - sequence listing, part 14

SEQ ID NO: 7383 - RNA, 9873 nt, synthetic construct
  misc_feature 1..9873: note = derived and/or modified CDS sequence (wt) from DENV-3__HM181972__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacattaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacatatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggttttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagcggcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacggatggaccagagcgggtgatcctggctggaccaatgccagtcaccgcggcgagtgctgcgcaaaggagagggagagttggcaggaatccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcggccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggcttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaactcttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggttaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctggggaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7384 - RNA, 9873 nt, synthetic construct
  misc_feature 1..9873: note = derived and/or modified CDS sequence (wt) from DENV-3__HM631857__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacacggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgctgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcgatagtcctggagttttttatgatggtgttgcttataccagaaccagaaaagcagagaaccccccaagacaaccaactcgcatatgtcgtgataggcatacttacactggctgcagtaatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgtggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagccgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7385 - RNA, 9873 nt, synthetic construct
  misc_feature 1..9873: note = derived and/or modified CDS sequence (wt) from DENV-3__HM631860__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccaaggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgtattttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7386 - RNA, 9873 nt, synthetic construct
  misc_feature 1..9873: note = derived and/or modified CDS sequence (wt) from DENV-3__HM181977__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccaaggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7387 - RNA, 9873 nt, synthetic construct
  misc_feature 1..9873: note = derived and/or modified CDS sequence (wt) from DENV-3__HM181978__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccctgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgcgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacacctcaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccagcgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggacttatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaactcttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagagggacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggcagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcagagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgactacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7388 - RNA, 9873 nt, synthetic construct
  misc_feature 1..9873: note = derived and/or modified CDS sequence (wt) from DENV-3__JN183884__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactctttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaaaaatgaagaacaaagcatggatggtacatagacaatggttttttgacctacctttaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatcttctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacgacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactacaacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagggtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttgggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7389 - RNA, 9873 nt, synthetic construct
  misc_feature 1..9873: note = derived and/or modified CDS sequence (wt) from DENV-3__HQ541785__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagttgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcagggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaggcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacctatggctggaccattagtggccgggggcttgctgatagcgtgctacgttataactggcacgtcagcagacctcaccgtagaaaaagcagcagatataacatgggaggaagaggctgagcaaacaggagtgtcccacaacttaatgatcgcagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggccagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaattggactcatttgtgtaattacttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactctacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggaaaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagatgacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7390 - RNA, 9873 nt, synthetic construct
  misc_feature 1..9873: note = derived and/or modified CDS sequence (wt) from DENV-3__HM181975__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcctgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgttctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgattacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcttggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgatacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7391 - RNA, 9873 nt, synthetic construct
  misc_feature 1..9873: note = derived and/or modified CDS sequence (wt) from DENV-3__HM631864__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagttgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccattttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcagggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagaaggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcaggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaactccacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgttataactggcacgtcagcagacctcaccgtagaaaaagcagcagatataacatgggaggaagaggctgagcaaacaggagtgtcccacaacttaatgatcgcagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtgcctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggccagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgccctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcagtaatagcagccaatgaaatgggattgctagaaactacaaagagagatttaggaatgtctaaggagccaggtgttgtctctccaaccagctatttagatgtggacttgcatccagcgtcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactctacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaacgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagatgacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7392 - RNA, 9873 nt, synthetic construct
  misc_feature 1..9873: note = derived and/or modified CDS sequence (wt) from DENV-3__HM631859__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacgtgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcagctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtaacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggagacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7393 - RNA, 9870 nt, synthetic construct
  misc_feature 1..9870: note = derived and/or modified CDS sequence (wt) from DENV-3__HM631856__SS-prME
  source 1..9870: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccaaggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcagaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7394 - RNA, 9873 nt, synthetic construct
  misc_feature 1..9873: note = derived and/or modified CDS sequence (wt) from DENV-3__HM756276__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcatgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcaaccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctacttttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatactcacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagttgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7395 - RNA, 9873 nt, synthetic construct
  misc_feature 1..9873: note = derived and/or modified CDS sequence (wt) from DENV-3__HM756279__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacacagtgattggaattggagacaacgccttgaaaatcaactggtataagaagggaagctctattgggaagatgttcgaggccactgccagaggtgcaaggcgcatggccatcttgggagatacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacattacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaaatttttgggaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttacagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaaccaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7396 - RNA, 9873 nt, synthetic construct
  misc_feature 1..9873: note = derived and/or modified CDS sequence (wt) from DENV-3__HQ891025__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgaaaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgttaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggattcttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatacggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgaattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7397 - RNA, 9873 nt, synthetic construct
  misc_feature 1..9873: note = derived and/or modified CDS sequence (wt) from DENV-3__HQ705617__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacagtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagctctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactctccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttagaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccgggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7398 - RNA, 9873 nt, synthetic construct
  misc_feature 1..9873: note = derived and/or modified CDS sequence (wt) from DENV-3__HQ705619__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacactaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggtcgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttataagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7399 - RNA, 9873 nt, synthetic construct
  misc_feature 1..9873: note = derived and/or modified CDS sequence (wt) from DENV-3__HQ705620__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcatacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagccacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgtcctgaactcattaggcaaaatggtgcaccaaatattcggaagtgcttacacagccctattcagtggagtctcttgggtaatgaaaattggaataggagttctcttgacttgggtagggttgaactcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggctgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaagactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtgtcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgtttaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacgacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagccaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccctcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaggaagttaaatcaattatcccggaaagactttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggacgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgttcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7400 - RNA, 9873 nt, synthetic construct
  misc_feature 1..9873: note = derived and/or modified CDS sequence (wt) from DENV-3__HQ705621__SS-prME
  source 1..9873: mol_type = other RNA
acatcgctctgtctcatgatgatattgccagcagcacttgctttccacttgacctcacgagacggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcatccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacgtgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcctgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctttaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcagctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggataggacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaattccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcaccatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcagagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7401 - RNA, 9873 nt, synthetic construct
  misc_feature 1..9873: note = derived and/or modified CDS sequence (wt) from DENV-3__HQ671176__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttgggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggagcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggattttaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgatagtaatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctacttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgatgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggggccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggatacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaattgatgacaggttcgctaatgccctactcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtga

SEQ ID NO: 7402 - RNA, 9873 nt, synthetic construct
  misc_feature 1..9873: note = derived and/or modified CDS sequence (wt) from DENV-3__HQ705609__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagtcctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccaaggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcggctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaagtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagccgcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaatagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttagagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7403 - RNA, 9873 nt, synthetic construct
  misc_feature 1..9873: note = derived and/or modified CDS sequence (wt) from DENV-3__HQ705610__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccatttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcctcacgtttgtgctccttctctcagggcaaataacatggaaagacatggcgcacacactaataatgattgggtccaacgcatctgacaggatgggaatgggcgttacctacctagctttaattgcaacatttaaaattcagccattcttggccttgggatttttcctaagaaaactgacatccagagaaaatttattgttaggagttgggctggctatggcaacaacgttacaactgccagaggacattgaacaaatggcgaatggaatcgctctggggctcatggctcttaaactgataacacaatttgaaacataccaattatggacagcattaatctccttaacgtgttcaaatacgatttctacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacgtgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaactggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaatattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatttggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacacaccatagagaattctacagcaaatgtatctctggcagctatagccaaccaggcagtggtcctgatgggtttggacaaaggatggccaatatcaaagatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaacgcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcaaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcccttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7404 - RNA, 9873 nt, synthetic construct
  misc_feature 1..9873: note = derived and/or modified CDS sequence (wt) from DENV-3__HQ705611__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaagatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgcgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7405 - RNA, 9873 nt, synthetic construct
  misc_feature 1..9873: note = derived and/or modified CDS sequence (wt) from DENV-3__HQ705612__SS-prME
  source 1..9873: mol_type = other RNA
acatcgctctgtctcatgatgatattgccagcagcacttgctttccacttgacctcacgagatggagagccgcgcatgattgtggggaagaatgaaagagggaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgacccttaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcgttaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatacaacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacacacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgccttccctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacttgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7406 - RNA, 9873 nt, synthetic construct
  misc_feature 1..9873: note = derived and/or modified CDS sequence (wt) from DENV-3__HQ705613__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactctttaagacggcctctggaattaacatgtgcacactcatagccatggacttgggagagatgtgtgatgacacggtcacttacaaatgcccccacatcactgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaacttaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatctctcatagaggtgaaaacctgcacatggccaaaatcacataccctttggagcaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacgacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactatcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaacgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgctttttttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagggtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatccagactgctactgaacaggttcacgatgacacacagaagacctaccattgagaaagatgtggatttgggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttttgctcccaccactttcatgaattgatcatgaaagatggaagaaagttggtggttccctgcagaccccaggacgaactaataggaagagcaagaatctctcaaggagcgggatggagccttaaagaaactgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7407 - RNA, 9873 nt, synthetic construct
  misc_feature 1..9873: note = derived and/or modified CDS sequence (wt) from DENV-3__HQ705615__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagttgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcagggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaggcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgatcttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacctatggctggaccattagtggccgggggcttgctgatagcgtgctacgttataactggcacgtcagcagacctcaccgtagaaaaagcagcagatataacatgggaggaagaggctgagcaaacaggagtgtcccacaacttaatgatcgcagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggccagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaattggactcatttgtgtaattacttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatatcactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactctacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggaaaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggtttgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagatgacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7408 - RNA, 9873 nt, synthetic construct
  misc_feature 1..9873: note = derived and/or modified CDS sequence (wt) from DENV-3__JF920398__SS-prME
  source 1..9873: mol_type = other RNA
acatcgctctgtctcatgatgatattgccagcagcacttgctttccacttgacctcacgggatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacataggcaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgctttgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaatgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccatttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcctcacgtttgtgctccttctctcagggcaaataacatggagagacatggcgcacacactaataatgattgggtccaacgcatctgacaggatgggaatgggcgttacctacctagctttaattgcaacatttaaaattcagccattcttggccttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacgtgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggatgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaactggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttggcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcacgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtccaaggagccaggtgttgtctctccaaccagctatttagatgtggacttgcatccagcatcagcctggacattgtacgccgtggccactacagtaataacaccaatgttaagacacaccatagagaattctacagcaaatgtatctctggcagctatagccaaccaggcagtggtcctgatgggtttggacaaaggatggccaatatcaaagatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaacgcgacatgttaatgcggaaccagaaacacccaatatggatgtcattggggaaagaataaaaaggatcaaggaggagcacaactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgtacaagggaagagtttacaaagaaggtcaggactaacgcagccatgggcgccgttttcacagaggagaaccaatgggacagcgcaaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagccctcggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcccttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7409 - RNA, 9873 nt, synthetic construct
  misc_feature 1..9873: note = derived and/or modified CDS sequence (wt) from DENV-3__JF920402__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtggggcaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcagctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggggtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7410 - RNA, 9873 nt, synthetic construct
  misc_feature 1..9873: note = derived and/or modified CDS sequence (wt) from DENV-3__JF937652__SS-prME
  source 1..9873: mol_type = other RNA
acatcgctctgtctcatgatgatactgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgataacacggtcacttacaaatgccctcacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccgtcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcttgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccatagcaggcgcttgggagaatggagtgtgcggaattaggtcaacaaccagaatggagaatctcctgtggaagcaaatagccaatgaactgaactacatattgtgggaaaacaatattaaactaacggtagttgtgggtgatataattggggtcttagagcaaggaaaaagaacactaacaccacaacccatggagctaaagtactcatggaaaacatggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaacttgggaagaaacacatgattgcgggggttttcttcacgtttgtgctccttctctcagggcaaataacatggagagacatggcgcacacactaataatgattgggtccaacgcatctgacaggatgggaatgggcgtcacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttgatgatcacagttgatgatgatggaacaatgagaataaaagatgatgagactgagaatatcctaacagtgcttttaaaaacagcgttactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaaaggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgctttttttaatatcaggtaaagggattggaaagacttcaataggacttatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacagggaaaagaggaacaggctcacaaggtgaaactttaggagaaaaatggaaaaagaagttaaaccaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagtccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcgcgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaggatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccagagaggcagtggacaggtaggaacttatggtctgaatacattcaccaacatgggagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatctaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7411 - RNA, 9873 nt, synthetic construct
  misc_feature 1..9873: note = derived and/or modified CDS sequence (wt) from DENV-3__JF920404__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcactatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaattattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacttgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaaggggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagaacctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaatgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7412 - RNA, 9873 nt, synthetic construct
  misc_feature 1..9873: note = derived and/or modified CDS sequence (wt) from DENV-3__JF937641__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcactatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagaacctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgactgatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtgttgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7413 - RNA, 9873 nt, synthetic construct
  misc_feature 1..9873: note = derived and/or modified CDS sequence (wt) from DENV-3__JF920396__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcatttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagctctcttgacttggatagggttgaactcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaagatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccatactcagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcaaccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctacttttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7414 - RNA, 9873 nt, synthetic construct
  misc_feature 1..9873: note = derived and/or modified CDS sequence (wt) from DENV-3__JF920406__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcactatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaattattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttgaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagaacctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaggaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactacaacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7415 - RNA, 9873 nt, synthetic construct
  misc_feature 1..9873: note = derived and/or modified CDS sequence (wt) from DENV-3__JF920409__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttggcccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcaaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggctttcttcatgtttgtgctccttctctcagggcaaataacatggagagacatggcgcacacactaataatgattgggtccaacgcatctgacaggatgggaatgggcgtcacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagtctgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattaaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggctgacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgactacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7416 - RNA, 9873 nt, synthetic construct
  misc_feature 1..9873: note = derived and/or modified CDS sequence (wt) from DENV-3__JF920408__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagactgaggccacccaattggcgaccctaaggaagctatgcattgaggggaaaattaccaacataacaactgactcaagatgtcctacccaaggggaagcgactttgcctgaggagcaggaccaaaactacgtgtgtaagcatacatacgtagatagaggctgggggaacggatgtggtttgtttggcaagggaagtttggtaacatgtgcgaaatttcaatgcctagaaccaatagagggaaaagtggtgcaatatgagaacctcaaatacaccgtcattattacagtgcacacaggagatcaacaccaggtgggaaatggaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaggtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatcttctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggccagggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagaaaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtctaacgcatctgacaggatgggaatgggcgtcacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaaccctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaagacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttggaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggactgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcggggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggaggtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaagtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaggatgacctgcacaatgaggaaaagatcacacagcaaatggaccctgaacacaggcagctagcggacgctatatttaagctcacataccaaaacaaagtggtcaaagttcaacgaccgactccaacaggcacggtaatggacatcatatctaggaaagaccaaagaggcagtggacaggtgggaacttatggtttgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctcccaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7417 - RNA, 9873 nt, synthetic construct
  misc_feature 1..9873: note = derived and/or modified CDS sequence (wt) from DENV-3__JF920397__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacgtgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggatcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaattaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcacacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcagctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaagaaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagatatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7418 - RNA, 9873 nt, synthetic construct
  misc_feature 1..9873: note = derived and/or modified CDS sequence (wt) from DENV-3__JN093513__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgtaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacgtgtgcgaaatttcaatgcctagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacacatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcagctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacatcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaactcttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagagggacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggcagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7419 - RNA, 9873 nt, synthetic construct
  misc_feature 1..9873: note = derived and/or modified CDS sequence (wt) from DENV-3__JF937624__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggagacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactataacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgagtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgttgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatccagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaaggatcatggggatcacagcggagtggctctggagaaccctgggaaggaacaaaaaacctaggttatgcacaagggaagaatttacaaagaaggtcaggactaacgcagccatgggcgctgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7420 - RNA, 9873 nt, synthetic construct
  misc_feature 1..9873: note = derived and/or modified CDS sequence (wt) from DENV-3__JN000938__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttaggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacgcgcacccaaacctggatgtcggctgaaggagcttggaggcaagtcgagaaggtagagacatgggcccttaggcacccagggttcaccatactagctctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaagaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaagacgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactctccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccttcagtgagaaagaagagaacatggtaaagtctttagtctcagcgggaggtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcttggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggcagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7421 - RNA, 9873 nt, synthetic construct
  misc_feature 1..9873: note = derived and/or modified CDS sequence (wt) from DENV-3__JN093515__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttacctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtagtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagagggaggagcctgtcaatattgaggctgaacctccttttggggaaagcaacatagtgattggaattggagacaacgccttgaaaatcaactggtacaagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggagtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccggctattgttagagaggcaatcaagagacgcttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgcttctggacaacattaatacaccagaagggatcataccagctctctttgagccagaaagggagaagtcagccgccatagacggtgagtatcgcctaaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaaccacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagaccctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatatcattggggaaagaataaaaaggatcaaggaggagcacaactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtgaacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7422 - RNA, 9873 nt, synthetic construct
  misc_feature 1..9873: note = derived and/or modified CDS sequence (wt) from DENV-3__JF937646__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggaataggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgcaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgttcgtgcacactccctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggtaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgctcttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgctcttaaaaacagcattactaatagtatcaggaatctttccatactccatacccgcaacattgctggtctggcatacctggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggtacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggtcggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggctactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7423 - RNA, 9873 nt, synthetic construct
  misc_feature 1..9873: note = derived and/or modified CDS sequence (wt) from DENV-3__JF937633__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccctgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgcgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaatcaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagccggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgtcacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagctgcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaaaaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagcatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtagaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcacccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaactcttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagagggacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggcagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacacgaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7424 - RNA, 9873 nt, synthetic construct
  misc_feature 1..9873: note = derived and/or modified CDS sequence (wt) from DENV-3__JF937634__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagatagaggctgggggaacggatgtggtttgtttggcaagggaagtttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatcttctgtggaagcaaatagtcaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggccagggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtctaacgcatctgacaggatgggaatgggcgtcacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaaccctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttggaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggactgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcggggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggaggtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaagtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaggatgacctgcacaatgaggaaaagatcacacagcaaatggaccctgaacacaggcagctagcggacgctatatttaagctcacataccaaaacaaagtggtcaaagttcaacgaccgactccaacaggcacggtaatggacatcatatctaggaaagaccaaagaggcagtggacaggtgggaacttatggtttgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctcccaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7425 - RNA, 9873 nt, synthetic construct
  misc_feature 1..9873: note = derived and/or modified CDS sequence (wt) from DENV-3__JF937636__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagcaacgtgggttgacgtggtgctcgagcacggggggtgtgtgactaccatggctaagaacaagccaacgttggatatagagcttcagaagaccgaggccacccaattggcgaccctaaggaagctatgcattgaggggaaaatcactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaagatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaatttcaagcagactccccaaaaagattggcgacagccattgcaggcgcttgggagaatggagtgtgcggaattaggtcaacaaccagaatggagaatctcctgtggaagcaaatagccaatgaactgaactacatattatgggaaaacaatatcaaactaacggtagttgtgggtgatataattggcgtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtatcttgtgcttggcaatcctctttgaagaggtgatgagaggaaaatttgggaagaaacacatgattgcgggggttttcttcacgtttgtgctccttctctcagggcaaataacgtggagagacatggcgcacacactaataatgattgggtccaacgcatctgacaggatgggaatgggcgttacttacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacctagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaagaaagatttgatctcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaggagacgtttaagaactctaattttggcaccgacaagggtggttgcagctgagatggaagaagcgttgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccacttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaattgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggacgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttgtgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcacgtgagaactcttacagtggagtggaaggagaaggactgcacaagctaggctatatattaagggacatttccaagatacccggaggagccatgtatgctgatgacacagccggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7426 - RNA, 9873 nt, synthetic construct
  misc_feature 1..9873: note = derived and/or modified CDS sequence (wt) from DENV-3__JF937626__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgtgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatatgacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcacacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcggaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggctagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccctagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggccttgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaagttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcgtccccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7427 - RNA, 9873 nt, synthetic construct
  misc_feature 1..9873: note = derived and/or modified CDS sequence (wt) from DENV-3__JF937621__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactctttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaatataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcatactgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagagacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacgacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtccttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccatttttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaagagcagcagatataacatgggaggaagaggctgagcaaacaggagtgtcccacaatttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctacaggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactacaacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaagaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccagtggatcgcgtcggcaatagtcctggagttttttatgatggtgttgcttataccagagccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagggtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttgggagcaggaactcgacatgttaatgcggaaccagaaacacccaatatggatgtcattggggaaagaataaaaaggatcaaggaggagcataactcaacatggcactatgatgacgaaaacccctacaaaacgtgggcttatcatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7428 - RNA, 9873 nt, synthetic construct
  misc_feature 1..9873: note = derived and/or modified CDS sequence (wt) from DENV-3__JF937623__SS-prME
  source 1..9873: mol_type = other RNA
gcatcgctctgtctcatgatgatattgccagcagcacttgctttccacttgacctcacgagatggagagccgcgcatgattgtggggaagaatgaaagaggaaaatccctactttttaagacggcctctggaatcaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagctggagagcatagacgtgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcataatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcggggattttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccacttttcatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatatgacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcacacttggcaaaagcaaacccaaagatccggcgttctatgggacgtacccagccccccagagacacagaaagcagaactggaagaagggatctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggccttgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaagttatgctcctggttttgtgtgcagtccaacttctgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcatccccgaaggaagagtcatagacttgggctgtggaagaggaggctggtcatattactgtgcaggactgaaaaaagtcacagaagtgcgaggatacacaaaaggaggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaataaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7429 - RNA, 9873 nt, synthetic construct
  misc_feature 1..9873: note = derived and/or modified CDS sequence (wt) from DENV-3__JF937637__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgcaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcgtcaaccactgaagccatcttgcctgaatatggaacccttgggctagaatgctcaccacggacaggcttggatttcaatgaaatgatcttgctaacaatgaagaataaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatgcctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagaaagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggattttttctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatttaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccgggaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagccgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagtcatagacctgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggtttacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctagattatgcacaagggaagaatttacaaagaaggtcaggactaacgcagccatgggcgccgttttcacagaggagaaccaatgggacagcgcgaaagctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgttaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7430 - RNA, 9873 nt, synthetic construct
  misc_feature 1..9873: note = derived and/or modified CDS sequence (wt) from DENV-3__JF937638__SS-prME
  source 1..9873: mol_type = other RNA
acatcgctctgtctcctgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcatacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagccacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgtcctgaactcattaggcaaaatggtgcaccaaatatttggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaagactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccggtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgtcctatgggacgtacccagccccccagagacacagaaagcagaactggaagaaggggtttataggatcaaacagcaaggaatttttggaaaaacccaagtaggagttggagtacagaaagaaggagtcttccacaccatgtggcacgttacaagaggggcagtgctgacatacaatgggaaaagactggaaccaaactgggctagcgtgaaaaaagatctgatttcatacggaggaggatggagattgagcgcacaatggcaaaaaggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccctcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattccacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgactcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaggaagttaaatcaattatcccggaaagactttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcactcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataacttaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagataatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcaggccccaggacgaactaataggaagggcaagaatctctcaaggagcgggatggagccttaaagagaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7431 - RNA, 9873 nt, synthetic construct
  misc_feature 1..9873: note = derived and/or modified CDS sequence (wt) from DENV-3__JF937639__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagaaggagcaatgcataccgctttgacaggagccacagaaatccaaaactcaggaggcacaagtatttttgcggggcacttaaaatgcagacttaagatggacaagttggaactcaaggggatgagttatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctaaactcattaggcaaaatggtgcaccaaatattcggaagtgcttacacagccctattcagtggagtctcttgggtaatgaaaattggaataggagttctcttgacttggatagggttgaactcaagaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacgaccaacatatggctgaaactccgagaggcgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccatttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcctcacgtttgtgctccttctctcagggcaaataacatggagagacatggcgcacacactaataatgattgggtccaacgcatctgacaggatgggaatgggcgttacctacctagctttaattgcaacatttaaaattcagccattcttggccttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacgtgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaaccaaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaactggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaagacggtgtggtttgtccccagcattaaggctggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacacaccatagagaactctacagcaaatgtatctctggcagctatagccaaccaggcagtggtcctgatgggtttggacaaaggatggccaatatcaaagatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaacgcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcaaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgttgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcccttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtcttatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7432 - RNA, 9873 nt, synthetic construct
  misc_feature 1..9873: note = derived and/or modified CDS sequence (wt) from DENV-3__JF937627__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaagtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttacctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtagtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaggctcacaatggcagactgattacagccaacccagtggtgactaagagggaggagcctgtcaatattgaggctgaacctccttttggggaaagcaacatagtgattggaattggagacaacgccttgaaaatcaactggtacaagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaattgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggagtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccctgattttggccggagtttcgcttttaccaatgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattgctaatagtatcaggaatctttccatactccatacccgcaacattgctggtctggcatacttggcaaaagcaaacccaaagatccggcgttctatgggacgtacccagccctccagagacacagaaggcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccggctattgttagagaggcaatcaagagacgcttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgcttctggacaacattaatacaccagaagggatcataccagctctctttgagccagaaagggagaagtcagccgccatagacggtgagtatcgcctaaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaaccacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagaccctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggcgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatatcattggggaaagaataaaaaggatcaaggaggagcacaactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtgaacaaagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7433 - RNA, 9873 nt, synthetic construct
  misc_feature 1..9873: note = derived and/or modified CDS sequence (wt) from DENV-3__KF973476__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacgggggatgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcatacaggagatcaacaccaggtgggaaatgaaacgcagggagtcacggctgagataacacctcaggcatcaaccactgaagccatcttgcctgaatatggaacccttgggctagaatgttcaccacggacaggtttggatttcaatgaaatgatcttgctaacaatgaagaacaaagcatggatggtacatagacaatggttttttgacctacctttaccatggacatcaggagccacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgtcctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaatatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacataggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacattcaaaattcagccattcttggctttgggatttttcctaagaagactgacatccagagaaaatttattgttaggagttgggctggctatggcaacaacgttacaactgccagaagacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcatgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaagaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagaggaggaaaggtagtgggactgtatggtaatggagtggttacaaagaatggtggctatgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaagcaatcacgagacggttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaatgctccaattcaagatgaagaaagggacataccagaacgctcatggaattcaggcaatgaatggataaccgacttcgctgggaaaacggtgtggtttgtccccagcattaaggccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccgtagacggtgagtatcgcctaaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccctcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttggcaggagctgggcttgctttttccattatgaaatcagtaggaacaggaaaaagaggaacaggctcacaaggtgaaactttaggagaaaaatggaaaaggaagttaaatcaattatcccggaaagactttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcatcaaagtgttgaacccttacatgccaactgtgattgagcacctagaaagactacaaaggaaacatggaggaatgcttgtgagaaatccactttcacgaaactccacgcacgaaatgtactggatatccaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgtacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccttatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgcccaaatgtggagtctcatgtattttcacagaagagacctcagactagcatccaacgccatatgttcagcagtgccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaagaggagtcggagggagccatttggtga

SEQ ID NO: 7434 - RNA, 9873 nt, synthetic construct
  misc_feature 1..9873: note = derived and/or modified CDS sequence (wt) from DENV-3__KF973478__SS-prME
  source 1..9873: mol_type = other RNA
acatcgctctgtctcatgatgatattgccagcagcacttgctttccacctgacctcacgagatggagagccgcgcatgattgtggggaagaatgaaagagggaaatccctactttttaagacggcctctggaatcaacatgtgcacactcatagccatggacttgggagagatgtgtgatgacacggtcacttacaaatgcccccacatcaccgaagtggaacctgaggacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaaaaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcttagaaccaatagagggaaaagtggtgcaacatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccctgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacatcacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtcctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacgagaggcccatcgttaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcaggacaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactctatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggcggctacgtcagcggaatagcgcaaacgaacgcagaaccagatggaccgacaccagaattggaagaagagatgtttaaaaaacgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacatcaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagcggggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggacagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaggctaggctatatattaagggacatttccaagatacccggaggagccatgtatgctgatgacacagctggttgggacacaagaataacagaagatgacttgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatttagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7435 - RNA, 9873 nt, synthetic construct
  misc_feature 1..9873: note = derived and/or modified CDS sequence (wt) from DENV-3__KF973479__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagatattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttctcgcccattacataggcacatccctgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgcgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaaacaagaagtagttgtccttggatcgcaagagggagcaatgcataccgcactgacaggagccacagaaattcaaaacttaggaggcacaagtatttttgcggggcacttaaaatgcagacttaagatggacaaattggagctcaaggggatgagttatgcaatgtgcacgaatacctttgtgttgaagaaagaagtctcagaaacgcagcatgggacaatactcattaaggtcgagtacaaaggggaagatgcgccttgcaagattcctttctcaacagaggatggacaagggaaagctcataatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactaaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactgacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacaaggggcccatcattaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccagcgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattgctaatagtatcaggaatctttccatactccatacccgcaacattgctggtctggcatacttggcaaaagcaaacccaaagatccggcgttctatgggacgtgcccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagtgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactttaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgttcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaaccctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaactcttgttaatgagaacatcatgggccttgtgtgaagctttaactctagccacaggaccaataacaacactctgggaaggatcacctgggaagttttggaacaccacgatagctgtttccatggcgaacattttcagagggagctatttagcaggagctgggcttgctttttccattatgaaatcagtaggaacaggaaaaagagggacaggctcacaaggtgaaactttaggagaaaaatggaaaaagaagttaaatcaattatcccggaaagactttgacctttacaagaaatctggaatcactgaagtggatagaacagaagccaaagaagggttgaaaagaggagaaataacacatcatgccgtgtccagaggcagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggtcagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattaggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaattcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaggaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7436 - RNA, 9873 nt, synthetic construct
  misc_feature 1..9873: note = derived and/or modified CDS sequence (wt) from DENV-3__KF973480__SS-prME
  source 1..9873: mol_type = other RNA
acatcgctctgtctcatgatgatattgccagcagcacttgctttccacctgacctcacgagatggagagccgcgcatgattgtggggaagaatgaaagagggaaatccctactttttaagacggcctctggaatcaacatgtgcacactcatagccatggacttgggagagatgtgtgatgacacggtcacttacaaatgcccccacatcaccgaagtggaacctgaggacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgactaccatggctaaaaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaagcaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatattcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacgtccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtcctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacgagaggcccatcgttaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgcgctccttctctcaggacaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtgcagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggcggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaactaagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacatcaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacagacatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggacagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgcgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacttgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7437 - RNA, 9873 nt, synthetic construct
  misc_feature 1..9873: note = derived and/or modified CDS sequence (wt) from DENV-3__KF973481__SS-prME
  source 1..9873: mol_type = other RNA
acatcgctctgtctcatgatgatattgccagcagcacttgctttccacctgacctcacgagatggagagccgcgcatgattgtggggaagaatgaaagagggaaatccctactttttaagacggcctctggaatcaacatgtgcacactcatagccatggacttgggagagatgtgtgatgacacggtcacttacaaatgcccccacatcaccgaagtggaacctgaggacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaaaaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcctagaaccaatagagggaaaagtggtgcaatatgagaacctcaaatacaccatcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgctcatgcgaagaagcaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgttaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtcctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgcgggacgagaggcccatcgttaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacagtgggtgtcttgtgcttggcaatcctctttgaagaggtgatgagaggaaaatttgggaagaaacacatgattgcgggggttttcttcacgtttgtgctccttctctcaggacaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataaccggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggcggctacgtcagcggaatagcgcaaacgaacgcagaaccagatggaccgacaccagaattggaagaagagatgttcaaaaagcgaaatctaaccataatggatcttcatcctgggtcagggaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaatgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacatcaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggacagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacttgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7438 - RNA, 9873 nt, synthetic construct
  misc_feature 1..9873: note = derived and/or modified CDS sequence (wt) from DENV-3__KF973482__SS-prME
  source 1..9873: mol_type = other RNA
acatcgctctgtctcatgatgatattgccagcagcacttgctttccacctgacctcacgagatggagagccgcgcatgattgtggggaagaatgaaagagggaaatccctactttttaagacggcctctggaatcaacatgtgcacactcatagccatggacttgggagagatgtgtgatgacacggtcacttacaaatgcccccacatcaccgaagtggaacctgaggacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaaaaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcctagaaccaatagagggaaaagtggtgcaatatgagaacctcaaatacaccatcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaatagaaaggagcttcttgtgacattcaaaaacgctcatgcgaagaagcaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgttaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtcctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgcgggacgagaggcccatcgttaagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacagtgggtgtcttgtgcttggcaatcctctttgaagaggtgatgagaggaaaatttgggaagaaacacatgattgcgggggttttcttcacgtttgtgctccttctctcaggacaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataaccggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggcggctacgtcagcggaatagcgcaaacgaacgcagaaccagatggaccgacaccagaattggaagaagagatgttcaaaaagcgaaatctaaccataatggatcttcatcctgggtcagggaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaatgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacatcaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggacagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgacaaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacttgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggctcagaacatacccacagcaattcaacaggtgagaagccttataggcaatgaagagtttctggactacatgccttcaatgaagagatttaggaaggaggaggagtcggagggagccatttggtaa

SEQ ID NO: 7439 - RNA, 9873 nt, synthetic construct
  misc_feature 1..9873: note = derived and/or modified CDS sequence (wt) from DENV-3__KF973483__SS-prME
  source 1..9873: mol_type = other RNA
acatcgctctgtctcatgatgatattgccagcagcacttgctttccacttgacctcacgagatggagagccgcgtatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgataagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggtttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacttggaacagaaaggagcttcttgtgacattcaaaaacgcacatgcgaagaaacaagaagtagttgtccttggatcgcaagagggagcaatgcataccgctttgacaggagccacagaaatccaaaactcaggaggcacaagtatttttgcggggcacttaaaatgcagacttaagatggacaagttggaactcaaggggatgagttatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctaaactcattaggcaaaatggtgcaccaaatattcggaagtgcttacacagccctattcagtggagtctcttgggtaatgaaaattggaataggagttctcttgacttggatagggttgaactcaagaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgtaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacgccggagtgtccaagtgtctcaagagcatggaatgtgtgggaggtggaagattacgggttcggagtcttcacaaccaacatatggctgaaactccgagagacgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccatttggagcaatggtgtgctagagagtgacatgatcatcccaaagagtctagctggtcctatttcgcaacacaaccacaggcccgggtaccacacccagacggcgggaccatggcatttaggaaaactagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcctcacgtttgtgctccttctctcagggcaaataacatggagagacatggcgcacacactaataatgattgggtccaacgcatctgacaggatgggaatgggcgtaacctacctagctttaattgcaacatttaaaattcagccattcttggccttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacgtgggaggaagaggctgagcaaacaggagtgtcccacaatttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggtcacaaagaatggtggctacgtcagcggaatagcgcaaacgaacgcagaaccagatggaccgacaccagaactggaagaagagatgttcaaaaagcgaaatctaaccataatggatctccatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataactgacttcgctgggaaaacggtgtggtttgtccccagcattaaggctggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatatttacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatttggacaaaggaaggagaaaagaaaaaactgagacctaggtggcttgatgcccgcacttattcagatcccttagcactcaaagaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcctgttgacaggtggagcaatgcttttcttaatatcaggtaaagggattggaaagacttcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacacaccatagagaattctacagcaaatgtatctctggcagctatagccaaccaggcagtggtcctgatgggtttggacaaaggatggccgatatcaaagatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggatagaacagaagccaaagaagggttaaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaacgcgacatgttaatgcggaaccagaaacacccaatatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcaaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagctagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgttgtcaaaggcagacctcgagaaccctcatctgccagagaagaaaattacacaatggttggaaaccaaaggagtggagaggttaaaaagaatggccattagcggggacgattgcgtagtgaaaccaatcgatgacaggttcgctaatgccctgctcgctctgaacgatatgggaaaagttcggaaagacatacctcaatggcagccatcaaagggatggcatgattggcaacaggttcccttctgctcccaccactttcatgaattgatcatgaaagatggaagaaagctggtggttccctgcagaccccaggacgaactaataggaagagcaagaatctctcaaggagcgggatggagccttaaagaaaccgcatgtctggggaaagcctacgctcaaatgtggagtcttatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7440 - RNA, 9873 nt, synthetic construct
  misc_feature 1..9873: note = derived and/or modified CDS sequence (wt) from DENV-3__KF973485__SS-prME
  source 1..9873: mol_type = other RNA
acatcgctctgtctcatgatgatattgccagcagcacttgctttccacttgacctcacgagatggagagccgcgcatgattgtggggaagaatgaaagaggaaaatccctactttttaagacggcctctggaattaacatgtgcacactcatagccatggacttgggagagatgtgtgatgacacggtcacttacaaatgcccccacatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacgtgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcatagaggggaaaattactaacataacaactgactcaagatgtcctacccaaggggaagcgactttgcctgaggagcaggaccaaaactacgtgtgtaagcatacatacgtagatagaggctgggggaacggatgtggtttgtttggcaagggaagtttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacagaaacaccaacctggaacaaaaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatcttctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgcacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtgctagagagtgacatgatcatcccaaagagtctagctggtcctatttcgcaacacaaccacaggccagggtaccacacccagacggcgggaccatggcatttaggaaaattagagctggacttcaactattgtgaaggaacaacggttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtccttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtctaacgcatctgacaggatgggaatgggcgtcacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgacggttgcctggagaacagccaccctgattttggccggagtttcgcttttaccagtgtgccagtcttcgagcatgaggaaaacagactggcttccaatggcagtggcagctatgggagttccacctctaccactttttatttttggcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacgggagtgtcccacaacttaatgatcacagttgatgatgatggaacaatgagaataaaagatgatgagactgagaatatcctaacagtgcttttaaaaacagcattactaatagtgtcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtgaaaaaagatctgatttcatacggaggaggatggagattgagcgcacaatggaaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaaccctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacattgcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgtggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttggaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaacaccccaagacaaccaactcgcatatgtcgtgataggcatactcacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagtacccctactggcattgggttgctattcacaagtgaacccactaactctaacagcggcagtactcttgctgatcacacattatgctattataggtccaggactgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgtagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaactatcccggaaagactttgacctttacaagaaatctggaatcactgaagtggataggacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcggggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggaggtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatatggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagaatttacaaagaaagtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaggatgacctgcacaatgaggaaaagatcacacagcaaatggaccctgaacacaggcagctagcggacgctatatttaagctcacataccaaaacaaagtggtcaaagttcaacgaccgactccaacaggcacggtaatggacatcatatctaggaaagaccaaagaggcagtggacaggtgggaacttatggtttgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctcccaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgcacaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7441 - RNA, 9873 nt, synthetic construct
  misc_feature 1..9873: note = derived and/or modified CDS sequence (wt) from DENV-3__KF973486__SS-prME
  source 1..9873: mol_type = other RNA
acatcgctctgtctcatgatgatattgccagcagcacttgctttccacctgacctcacgagatggagagccgcgcatgattgtggggaagaatgaaagagggaaatccctactttttaagacggcctctggaatcaacatgtgcacactcatagccatggacttgggagagatgtgtgatgacacggtcacttacaaatgcccccacatcaccgaagtggaacctgaggacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaaaaacaagccaacgttggatatagagcttcagaagaccgaggccacccaattggcgaccctaaggaagctatgcattgaggggaaaattactaacataacaactgactcaagatgtcctacccaaggggaagcgactttgcctgaggagcaggaccaaaactacgtgtgtaagcatacatacgtagacagaggctgggggaacggatgtggcttgtttggcaagggaagcttggtaacatgtgcgaaatttcaatgcctagaaccaatagagggaaaagtggtgcaatatgagaacctcaaatacaccgtcatcattacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacagaaaggagcttcttgtgacattcaaaaacgcacatgcgaagaagcaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagttatgcaatgtgcacgaatacctttgtgttgaagaaagaagtctcagaaacgcagcatgggacaatactcattaaggtcgagtacaaaggggaagatgtgccttgcaagattcctttctccacagaggatggacaagggaaagctcacaatggcagactgattacagccaacccagtggtgaccaagaaggaggagcctgtcaatattgaggctgaacctccttttggggaaagcaacatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaactaacggtagttgtgggtgatataattggggtcttagagcaaggaaaaagaacactaacaccacaacccatggagctaaagtactcatggaaaacgtggggaaaggcaaaaatagtgacagctgaaacacaaaattcctctttcataatagacgggccaaacacaccggagtgtccaagtgtctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctggaaaaagcatccctcatagaggtgaaaacctgcacatggccaaaatcacataccctttggagtaatggtgtcctagagagtgacatgatcatcccaaagagtctagctggtcctatttcgcaacacaaccacaggcccgggtaccacacccagacggcgggaccatggcatttaggaaaattagagctggacttcaactattgtgaaggaacaacggttgtcattacagaaaactgtgggacgagaggcccatcgttaagaacaacaacagtgtcagggaagttaatacacgaatggtgttgccgctcgtgcacgcttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcaggacaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacgatttttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttggcttgaaagacacactcaaaaggagaagctggccactgaatgaaggggtgatggctgttgggcttgtgagcattctggccagttctctccttagaaatgatgtacctatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttaaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggagttggagtacagaaagaaggagtcttccacaccatgtggcacgttacaagaggggcagtgttgacatacaatgggaaaagactggaaccaaactgggctagcgtaaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggcggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggtcccaaactataacttgataataatggatgaagcccatttcacagacccagccagtatagcggctagagggtacatatcgactcgtgttggaatgggagaggcagccgcaattttcatgacagcaacgccccctggaacagctgacgcctttcctcagagcaacgctccaattcaagatgaagaaagggacataccagaacgctcatggaattcaggcaatgaatggataaccgacttcgctgggaaaacggtgtggtttgtccccagcattaaggccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacatcaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaactgagacctaggtggcttgatgcccgcacttattcagatcccttagcactcaaggaattcaaggaatttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccagtggatcgcgtcggcaatagtcctggagttttttatgatggtgttgcttataccagaaccagaaaagcagagaaccccccaagacaaccaactcgcatatgtcgtgataggcatacttacactggctgcaataatagcagccaatgaaatgggattgctagaaactacaaagagagatttaggaatgtctaaggagccaggtgttgtctctccaaccagctatttagatgtggacttgcatccagcatcagcctggacattgtacgccgtggccactacagtaataacaccaatgttaagacataccatagagaattctacagcaaatgtatctctggcagctatagccaaccaggcagtggtcctgatgggtctggacaaaggatggccaatatcaaaaatggacttaggagcacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagactttgacctttacaagaaatctggaatcactgaagtggacagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccttgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacatcgtcgcttcagtcaatatggtatctagactgctactgaacaggttcacgatgacacacagaagacctaccattgagaaagatgtggatttaggagcaggaactcgacatgttaatgcggaaccagaaacacccaatatggatgtcattggggaaaggataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggtcatggggatcacagcggagtggctctggagaaccctgggaaggaacaagaaacctaggttatgcacaagggaagaatttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggctgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacttgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttaaagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7442 - RNA, 9873 nt, synthetic construct
  misc_feature 1..9873: note = derived and/or modified CDS sequence (wt) from DENV-3__FJ898458__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaaaccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggtacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacattcaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatgacagtggcagctatgggagttccacctctaccactttttattttcagcttgaaagacacactcaaaaggagaagctggccactgaatgaaggggtgatggctgttgggcttgtgagcattctggctagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggaaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaagaaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacataggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7443 - RNA, 9873 nt, synthetic construct
  misc_feature 1..9873: note = derived and/or modified CDS sequence (wt) from DENV-3__KJ189256__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggtacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacctggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7444 - RNA, 9873 nt, synthetic construct
  misc_feature 1..9873: note = derived and/or modified CDS sequence (wt) from DENV-3__KJ189257__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcatcgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggtacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacacatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagggagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgtcacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtagaaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagacattcgtggaactcatgaggaggggtgaccttccagtctggttagcccacaaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgttattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctggaaactacaaagagagacttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtattcttgctgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagtattgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactccttactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattaggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggatacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7445 - RNA, 9873 nt, synthetic construct
  misc_feature 1..9873: note = derived and/or modified CDS sequence (wt) from DENV-3__KJ189262__SS-prME
  source 1..9873: mol_type = other RNA
acatcgctctgtctcatgatgatattgccagcagcacttgcttttcacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccactacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcatttaaaatgcagacttaagatggacaaattggaactcaaggggatgagctatgcaatgtgcacgaatacctttgtgttgaagaaagaagtctcagaaacgcagcatgggacaatactcattaaggttgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggattttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacggtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaaggggggcagtgttgacatataatgggaaaagactggaaccaaactgggctagcgtgaaaaaagatctgatttcatacggaggaggatggagattgagcgcacaatggcaaaagggagaggaggtgcaggttattgccatagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaattaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagcagcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggagagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtgataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaacccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaagcttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaaggagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagacgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagagggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7446 - RNA, 9873 nt, synthetic construct
  misc_feature 1..9873: note = derived and/or modified CDS sequence (wt) from DENV-3__KJ189263__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgtctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacagtactcattaaggtcgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactagaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacagggagagagattgttgatctgatgtgccacgcaacgttcacaatgcgtctgctgtcaccagttagggttccaaactataacctgataataatggatgaagcccatttcacagacccagccagtatagcggctagagggtatatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacagtggatgggataatgacaatagacctagatcctgtaatatatgattcaaaatttgaaaagcaactgggacaggttatgctcctggttttgtgtgcagtccaacttttgttgatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggttgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7447 - RNA, 9873 nt, synthetic construct
  misc_feature 1..9873: note = derived and/or modified CDS sequence (wt) from DENV-3__KJ189265__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgctggatatagagcttcagaagaccgaggccacccaattggcgaccctaaggaagctatgcatcgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggtacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggttgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcatggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattatgggttcggagtcttcacaaccaacatatggctgaaactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggcgtcttgtgtttggcaatcctctttgaagaggtgatgagaggaaaatttgggaagaaacacatgattgcgggggttttctttacgtttgtgctccttctctcagggcaaataacatggagagacatggcgcacacactaataatgattgggtccaacacatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagtatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcaaatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcacacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatcccctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgtcacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtagaaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgttattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacactggctgcaataatagcagccaatgaaatgggattgctggaaactacaaagagagacttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagtattgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattaggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggatacaagaataacagaagatgacctgcacaatgaggaaaagatcacacagcaaatggaccctgaacacaggcagttagcgaacgctatatttaagctcacataccaaaacaaagtagtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggagatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7448 - RNA, 9873 nt, synthetic construct
  misc_feature 1..9873: note = derived and/or modified CDS sequence (wt) from DENV-3__KJ189266__SS-prME
  source 1..9873: mol_type = other RNA
acatcgctctgtctcatgatgatattgccagcagcacttgcttttcacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccactacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggttgagtacaaaggggaagatgtaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggattttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttagggaaattagagctggacttcaactattgtgagggaacaacagttgtcatcacagaaaactgtgggacaagaggcccatcattgagaacaacaacggtgtcagggaagttaatacacgaatggtgttgccgctcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttgacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaaggggggcagtgttgacatataatgggaaaagactggaaccaaactgggctagcgtgaaaaaagatctgatttcatacggaggaggatggagattgagcgcacaatggcaaaagggagaggaggtgcaggttattgccatagagcctgggaagaacccaaagaactttcaagccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaattaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgtttacaatgcgtctgctgtcaccagttagggttccaaactataacctgataataatggatgaagcccatttcacagacccagccagtatagcggctagagggtacatatcgactcgtgttggaatgggagaggcagcagcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggagagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaatcttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtgataacaccaatgttaagacataccatagagaattctacagcaaatgtgtctctggcagctatagccaaccaggcagtggtcctgatgggtctggacaaaggatggccaatatcaaaaatggacttaggagtacccctactggcattgggttgttattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaagcttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaaggagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagacgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagatcaaagaggcagtggacaggtaggaacttatggtctgaatacattcaccaacatggaagcccagttaatcagacaaatggaaggagagggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccctacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7449 - RNA, 9873 nt, synthetic construct
  misc_feature 1..9873: note = derived and/or modified CDS sequence (wt) from DENV-3__KJ189268__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgctagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgacgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgaaaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaacaatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaagcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7450 - RNA, 9873 nt, synthetic construct
  misc_feature 1..9873: note = derived and/or modified CDS sequence (wt) from DENV-3__KJ189271__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagttgagaaggtagagacatgggcccttaggcacccaggattcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcaaaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaacttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatctagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctttaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagataggaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttttgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7451 - RNA, 9873 nt, synthetic construct
  misc_feature 1..9873: note = derived and/or modified CDS sequence (wt) from DENV-3__KJ189272__SS-prME
  source 1..9873: mol_type = other RNA
acatcgctctgtctcatgatgatattgccagcagcacttgcgttccacttgacttcacgagatggagagccgcgcatgattgtggggaagaatgaaagaggaaaatccctacttttcaagacagcctctggaattaacatgtgcacactcatagccatggacttgggagagatgtgtgatgacacggtcacttacaaatgcccctacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcagtattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgatcataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacgctaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgacgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacgcagatggcaatgacagacacaactccatttggccagcaaagagtctttaaagagaaagtagacaccaggacacccaggtccatgccaggaacaagaagggtcatggggatcacagcggagtggctctggagaaccctgggaaggaacaaaaaacccaggttatgcacaagggaagagttcacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagcagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacttgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgacgacaggttcgctaatgccctgctcgctctgaacgatatgggaaaggttcgaaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7452 - RNA, 9873 nt, synthetic construct
  misc_feature 1..9873: note = derived and/or modified CDS sequence (wt) from DENV-3__KJ189273__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagtcaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaacacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttattttcagcttgaaagacacactcaaaaggaggagctggccactgaacgaaggggtgatggctgttgggcttgtgagcattctggccagttctctccttagaaatgatgtacccatggctggaccattagtggccgggggattgctgatagcgtgctacgtcataactggtacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaacttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattacgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaatgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaggacatgcttactgtctggaacagggtatggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7453 - RNA, 9873 nt, synthetic construct
  misc_feature 1..9873: note = derived and/or modified CDS sequence (wt) from DENV-3__KJ189274__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagcctacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagctaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaggagggagcaatgcatactgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaacggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaagaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttattttcagcttgaaagacacactcaaaaggaggagctggccactgaacgaaggggtgatggctgttgggcttgtgagcattctggccagttctctccttagaaatgatgtacccatggctggaccattagtggccgggggattgctgatagcgtgctacgtcataactggtacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagccatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcagggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagttcctggactacatgccttcaatgaagagatttaggaaggaggaggagtcggagggagccatttggtaa

SEQ ID NO: 7454 - RNA, 9873 nt, synthetic construct
  misc_feature 1..9873: note = derived and/or modified CDS sequence (wt) from DENV-3__KJ189275__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagcctacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagctaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaggagggagcaatgcatactgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaacggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaagaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagctaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcgaatggaattgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagccatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcagggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagttcctggactacatgccttcaatgaagagatttaggaaggaggaggagtcggagggagccatttggtaa

SEQ ID NO: 7455 - RNA, 9873 nt, synthetic construct
  misc_feature 1..9873: note = derived and/or modified CDS sequence (wt) from DENV-3__KJ189276__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaaaagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatctttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttacaatgctcaccacggacaggtttggatttcaatgaaatgatcttgctaacaatgaagaacaaagcatggatggtacatagacaatggttttttgacctacccttaccatggacatcaggagctacatcggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaactagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagctaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcgaatggaattgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtcttaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaagagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactgcaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatggaacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcggttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7456 - RNA, 9873 nt, synthetic construct
  misc_feature 1..9873: note = derived and/or modified CDS sequence (wt) from DENV-3__KJ189277__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaaaagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatctttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttacaatgctcaccacggacaggtttggatttcaatgaaatgatcttgctaacaatgaagaacaaagcatggatggtacatagacaatggttttttgacctacccttaccatggacatcaggagctacatcggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaactagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggcgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaagctgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagttcagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtcttaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaagagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactgcaaaggaaacatggaggaatgcttgtgagaaatccactttcacgaaactccacgcacgaaatgtactggatatccaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatggaacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcggttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7457 - RNA, 9873 nt, synthetic construct
  misc_feature 1..9873: note = derived and/or modified CDS sequence (wt) from DENV-3__KJ189278__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaactaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatgtcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgatcataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacgctaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgacgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtattgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagaccacaacaggggaaataggggcaattgcactagatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcattggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtgtctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtagacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaaaatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7458 - RNA, 9873 nt, synthetic construct
  misc_feature 1..9873: note = derived and/or modified CDS sequence (wt) from DENV-3__KJ189279__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagtcaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgaatacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccatcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaggagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgctgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacattcacaatgcgtctgctgtcaccagttagggttccaaactacaacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggttattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaggacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7459 - RNA, 9873 nt, synthetic construct
  misc_feature 1..9873: note = derived and/or modified CDS sequence (wt) from DENV-3__KJ189280__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgccctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcactgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgatcataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcattacagaaaactgtgggacaagaggcccatcattgagaacaacaacagtgtcagggaagttaatacacgaatggtgttgccgctcttgcacacttcctcccctgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagtttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacattcacaatgcgtctgctgtcaccagttagggttccaaactacaacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataactgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtatcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggacttatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaaggcataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagttcacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7460 - RNA, 9873 nt, synthetic construct
  misc_feature 1..9873: note = derived and/or modified CDS sequence (wt) from DENV-3__KJ189281__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcaaaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacagtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtagaagattatgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacacaccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggttttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgaccgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattactggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagataggaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgctaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtccctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaatatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggagtgctgtcaaaggcagacctggagaaccctcatctgccagagaagaaaattacacaatggttggaaactaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttttgctcccaccacttccatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7461 - RNA, 9873 nt, synthetic construct
  misc_feature 1..9873: note = derived and/or modified CDS sequence (wt) from DENV-3__KJ189282__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaaaacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtctgctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcatggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtagtgcaatatgagaatctcaaatacaccgtcatcatcacagtgcatacaggagatcaacaccaggtgggaaatgaaacgcagggagtcacggctgagataacacctcaggcatcaaccactgaagccaccttgccagaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattgggatcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggcgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagttcagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaaccaaactgaatgattgggacttcgtggtgacaactgacatttcagaaatgggggccaatttcaaagctgacagagtgatcgacccaagaagatgtctcaagccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaatatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggaattttttatgatggtgttgctcataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatctagcaggagctgggcttgctttttctatcatgaaatcagtaggaacagggaagagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggcgaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatggcaggaacaagaagggtcatggggatcacagcggagtggctctggagaaccctgggaaggaacaaaaaacccaggttatgcacaagggaagagtttacaaagaaggtcagaactaacgcagccatgggcgccgtcttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacctggaggagccatgtatgctgatgacacagctggttgggacacaagaataacagaagatgacctgcacaatgaggaaaagattacacagcaaatggaccctgaacacaggcagttagcgaacgctatatttaagcttacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatttagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7462 - RNA, 9873 nt, synthetic construct
  misc_feature 1..9873: note = derived and/or modified CDS sequence (wt) from DENV-3__KJ189283__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagcctacgttggatatagagcttcagaagaccgaggccacccaattggcgaccctaaggaagctatgcattgaggggaaaattaccaacataacaactgactcaagatgtcctacccaaggggaagcggttctgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaggagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctcttttataatagacgggccaaacacaccggagtgtccaagtgcctcaagagcatggaatgtgtgggaggtggaagattatgggttcggagttttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccaaacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaaaacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttattttcagcttgaaagacacactcaaaaggaggagctggccactgaacgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagacagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggttggccaatatcaaaaatggacttaggagtacccttactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccattcggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatactcacagcaattcaacaggtgagaagccttataggcaatgaagagtttctggattacatgccttcaatgaagagatttaggaaggaggaggagtcggagggagccatttggtaa

SEQ ID NO: 7463 - RNA, 9873 nt, synthetic construct
  misc_feature 1..9873: note = derived and/or modified CDS sequence (wt) from DENV-3__KJ189284__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagtttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagtcaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaatcaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgatcataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcattacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacgctaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgacgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtattgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagaccacaacaggggaaataggggcaattgcactagatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaggacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7464 - RNA, 9873 nt, synthetic construct
  misc_feature 1..9873: note = derived and/or modified CDS sequence (wt) from DENV-3__KJ189286__SS-prME
  source 1..9873: mol_type = other RNA
acatcgttctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcaaaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacagtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgatcataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcattacagaaaactgtgggacaagaggcccatcattgagaacaacaacagtgtcagggaagttaatacacgaatggtgttgccgctcttgcacacttcctcccctgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttaatttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagataggaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgctaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtccctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaatatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggagtgctgtcaaaggcagacctggagaaccctcatctgccagagaagaaaattacacaatggttggaaactaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttttgctcccaccacttccatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagggaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7465 - RNA, 9873 nt, synthetic construct
  misc_feature 1..9873: note = derived and/or modified CDS sequence (wt) from DENV-3__KJ189287__SS-prME
  source 1..9873: mol_type = other RNA
acatcgctctgtctcatgatgatattaccagcagcacttgctttccacttgacttcacgagatggagagccgcgcatgattgtggggaagaatgaaagaggaaaatccctactttttaaaacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcatggggggtgtgtgactaccatggctaagaataagccaacgttggatatagagcttcagaagaccgaggccacccaattggcgaccctaaggaagctatgcattgaggggaaaattaccaacataacaactgactcaagatgtcctactcaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtagtgcaatatgagaatctcaaatacaccgtcatcatcacagtgcatacaggagatcaacaccaggtgggaaatgaaacgcagggagtcacggctgagataacacctcaggcatcaaccactgaagccaccttgccagaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattgggatcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtagaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacacaccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagaaacatggcgcacacactaataatgattgggtccaacgcatctgacaggatgggaatgggcgttacctacctagctttaattgcaacatttaaaattcagccattcttggttttgggattttttctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgaccgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattactggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaagccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaatatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggaattttttatgatggtgttgctcataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatctagcaggagctgggcttgctttttctatcatgaaatcagtaggaacagggaagagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggcgaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatggcaggaacaagaagggtcatggggatcacagcggagtggctctggagaaccctgggaaggaacaaaaaacccaggttatgcacaagggaagagtttacaaagaaggtcagaactaacgcagccatgggcgccgtcttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacctggaggagccatgtatgctgatgacacagctggttgggacacaagaataacagaagatgacctgcacaatgaggaaaagattacacagcaaatggaccctgaacacaggcagttagcgaacgctatatttaagcttacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagtggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatttagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7466 - RNA, 9873 nt, synthetic construct
  misc_feature 1..9873: note = derived and/or modified CDS sequence (wt) from DENV-3__KJ189288__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaactaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaaatggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcccgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatgtcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggcgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggcgttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaagctgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagttcagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcattggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttgtaccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtgtctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtagacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaaaatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7467 - RNA, 9873 nt, synthetic construct
  misc_feature 1..9873: note = derived and/or modified CDS sequence (wt) from DENV-3__KJ189289__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctacttttcaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatatttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgaaataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtacaagctgacatggggtgtgttataaactggaaaggcaaagaactcaaatgtggaagtggaatcttcgtcaccaacgaggtccatacctggacagagcaatacaaattccaagcggactccccaaaaagattggcgacagccattgcaggtgcttgggagaatggagtgtgcggaattaggtcaacaaccagaatggaaaatctcctgtggaagcaaatagccaatgaactgaactacatattgtgggaaaacaatatcaaattaacggtagttgtgggcgatacaattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacatatcaattgtggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccacaaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaagactttgcggctggcagaaagtcaatcgcccttgatcttgtgacagaaataggaagagtgccttcacacctagcccatagaacgagaaacgctctggacaatctggtaatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttcttcaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtgatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatttctaatggcacaggtaacattgtcgcctcagtcaatatggtatctagactgctactgaacaggttcacgatgacacacagaagacccaccattgagaaagatgtggatttgggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacgcagatggcaatgacagacacaactccatttggccagcaaagagtctttaaagagaaagtagacaccaggacacccaggtccatgccaggaacaagaagggtcatggggatcacagcggagtggctctggagaaccctgggaaggaacaaaaaacccaggttatgcacaagggaagagttcacaaagaaggtcagaaccaacgcagccatgggcgccgttttcacagaggagaaccaatgggacagcgcgaaaactgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagcagagctatatggtacatgtggttgggagccaggtaccttgagtttgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgcccaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7468 - RNA, 9873 nt, synthetic construct
  misc_feature 1..9873: note = derived and/or modified CDS sequence (wt) from DENV-3__KJ189290__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccttatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagcctacgttggatatagagcttcagaagaccgaggccacccaattggcgaccctaaggaagctatgcattgaggggaaaattaccaacataacaactgactcaagatgtcctacccaaggggaagcggttctgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacactgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaggagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttaacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattatgggttcggagttttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtatcacacccaaacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagaaacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactctttattttcagcttgaaagacacactcaaaaggaggagctggccactgaacgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgctgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggatttgcacccagcatcagcctggacattgtacgccgtggccactacagtaataacaccaatgttaagacataccatagagaattccacagcaaatgtgtctctggcagctatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccgataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaaccaattatcccggaaagagtttgacctttacaagagatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgtcaatgcagaaccagaaacacccaacatggatgtcattggggaaagaataaaaaggatcaaggaggagcataattcaacatggcactatgatgaagagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagctatttggtaa

SEQ ID NO: 7469 - RNA, 9873 nt, synthetic construct
  misc_feature 1..9873: note = derived and/or modified CDS sequence (wt) from DENV-3__KJ189291__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccttatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagcctacgttggatatagagcttcagaagaccgaggccacccaattggcgaccctaaggaagctatgcattgaggggaaaattaccaacataacaactgactcaagatgtcctacccaaggggaagcggttctgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacactgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaggagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttaacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattatgggttcggagttttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtatcacacccaaacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagaaacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactctttattttcagcttgaaagacacactcaaaaggaggagctggccactgaacgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgctgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggatttgcacccagcatcagcctggacattgtacgccgtggccactacagtaataacaccaatgttaagacacaccatagagaattccacagcaaatgtgtctctggcagctatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccgataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaaccaattatcccggaaagagtttgacctttacaagagatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgtcaatgcagaaccagaaacacccaacatggatgtcattggggaaagaataaaaaggatcaaggaggagcataattcaacatggcactatgatgaagagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggactctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagctatttggtaa

SEQ ID NO: 7470 - RNA, 9873 nt, synthetic construct
  misc_feature 1..9873: note = derived and/or modified CDS sequence (wt) from DENV-3__KJ189292__SS-prME
  source 1..9873: mol_type = other RNA
acgtcgctctgtctcatgatgatattgccagcagcacttgctttccacttgacttcacgagatggagagccgcgcatgatagtggggaagaatgaaagaggaaaatccctactttttaagacagcctctggaatcaacatgtgcacactcatagccatggacttgggagagatgtgtgatgacacggtcacttacaaatgtccccacattaccgaagcggaacccgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaagaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaaaattcctttctccacagaggatggacacgggaaagctcacaatggcagactgattacagccaacccagtggtgactaagaaggaggagcctgtcaatattgaggctgaacctccttttggggaaagtaatataatgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtattataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacactcaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatctcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccattagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacttttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagacataacgtgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatcccaggcacttttcagactacaacaggggaaataggggcaattgcactggacttcaagcctggaacttcaggatctcctatcataaacagagagggaaaggtagtgggactgtatggtaatggagtggttacaaagaatggtggttacgtcagcggaatagcacaaacgaatgcagaaccagatggatcgacaccagaattggaagaagagatgttcaaaaagcgaaatctaaccataatggatcttcatcctgggtcaggaaagacacggaaataccttccagctattgttagagaggcaatcaagagacgtctaagaacacttattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgtggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttggcccataaagtagcatcagaagggatcaaatatacagacagaaaatggtgttttgatggacaacgtaacaatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaaggaattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttattgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgcgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggacagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgcgcaggactgaaaaaagtcacagaagtgcgaggatacacaaaaggcggtccaggacatgaagaaccagtacctatgtccacatatggatggaacatagttaagttaatgagtggaaaagatgtgttttatcttccacctgaaaagtgtgacaccttgctgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactacacaaactaggctatatattaagggacatttccaaaatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagtccagttaatcagacaaatggaaggagaaggtgtgctgtcaaaggcagacctggagaacccccatctgccagagaagaaaattacacaatggttggaaaccaaaggagtggagaggttaaaaagaatggccattagtggggatgattgcgtggtgaaaccaatcgatgacaggttcgctaatgccctgctcgctctgaacgatatgggaaagattcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttattggcaatgaagagtttctggactacatgccttcaatgaagagatttaggaaggaggaggagtcggagggagccatttggtaa

SEQ ID NO: 7471 - RNA, 9873 nt, synthetic construct
  misc_feature 1..9873: note = derived and/or modified CDS sequence (wt) from DENV-3__KJ189293__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggctatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7472 - RNA, 9873 nt, synthetic construct
  misc_feature 1..9873: note = derived and/or modified CDS sequence (wt) from DENV-3__KJ189294__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtagtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattgggatcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtagaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgaccgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggcgaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggttagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7473 - RNA, 9873 nt, synthetic construct
  misc_feature 1..9873: note = derived and/or modified CDS sequence (wt) from DENV-3__KJ189295__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccttatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaaaacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgatttttacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaattgggctagcgtgaaaaaagatctgatttcatacggaggaggatggagattgagcacacaatggcaaaagggagaggaggtgcaggttattgccgtagagcctggaaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggactttgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttactgatcacacattatgccattataggtccaggattgcaggcaaaagctactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaatatagttaagttaatgagtggaaaggatgtgttttatctaccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagctacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgttaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacagaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7474 - RNA, 9873 nt, synthetic construct
  misc_feature 1..9873: note = derived and/or modified CDS sequence (wt) from DENV-3__KJ189297__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacgttcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcctgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatagcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttcccagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7475 - RNA, 9873 nt, synthetic construct
  misc_feature 1..9873: note = derived and/or modified CDS sequence (wt) from DENV-3__KJ189298__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccttatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagcctacgttggatatagagcttcagaagaccgaggccacccaattggcgaccctaaggaagctatgcattgaggggaaaattaccaacataacaactgactcaagatgtcctacccaaggggaagcggttctgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctttaccatggacatcaggagctacaacggaaacaccaacctggaacaggaaggagcttcttgtgacattcaaaaacgcacatgcgaagaaacaagaagtagttgtccttggatcgcaggagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattatgggttcggagttttcacaaccaacatatggttgagactccgagaggtgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccaaacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggttgctggtatggtatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagaaacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttattttcagcttgaaagacacactcaaaaggaggagctggccactgaacgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagacataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttttatgggacgtacccagccccccagagacacagaaagcagaactggaagaaggggtctataggatcaaacagcaaggaatttttggaaaaacccaagtaggggttggagtacagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacaacaggggaaataggggcaattgcactggatttcaagcctggaacttcaggatctcctatcataaacagagagggaaaggtagtgggactgtatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctaaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgctgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattccacagcaaatgtgtctctggcagctatagccaaccaggcagtggtcctgatgggtttggacaaaggttggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgaagagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7476 - RNA, 9873 nt, synthetic construct
  misc_feature 1..9873: note = derived and/or modified CDS sequence (wt) from DENV-3__KJ189301__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaactaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgcttgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaatctcaaatacaccgtcatcatcacagtgcatacaggagatcaacaccaggtgggaaatgaaacgcagggagtcacggctgagataacacctcaggcatcaaccactgaagccaccttgcctgaatatggaacccttgggttagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcactagtatttttgcggggcacttaaaatgcagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacacgggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggaggtgttctgaactcattaggcaaaatggtgcaccaaatattcggaagtgcttacacagccctattcagtggagtctcttgggtaatgaaaattggaataggagttctcttgacttggatagggctgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatataaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatgtcaaattaacggtagttgtgggcgatataattggggtcttagagcggggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggttgagactccgagaggcgtacacccaactatgtgaccataggctaatgtcggcagccgtcaaggatgagagggccgtacatgccgacatgggctattggatagaaagtcaaaagaatggaagttggaagctagaaaaagcatccctcatagaggtgaagacctgcacatggccaaaatcacataccctttggagtaacggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgtcgctcgtgcacacttcctcccttgcgatacatgggagaagacggttgctggtatggtatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgataggatgggaatgggcgttacctacctagctttaattgcaacatttaaaattcagccattcttggctttgggatttttcctaagaaagctgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacgattttcacgttgactgttgcctggagaacagccaccttgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggtacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagttcagaaagaaggggtcttccacaccatgtggcacgttacaagaggggcagtgttgacatataatgggaaaagactggaaccaaactgggctagcgtgaaaaaagatctgatttcatacggaggaggatggagattgagcacacaatggcaaaagggagaggaggtgcaggttattgccgtagagcctgggaagaacccaaagaactttcaaaccatgccaggcacttttcagactacgacaggggaaataggggcaattgcactggatttcaagcctggaacttcaggatctcctatcataaacagagagggaaaggtagtgggactttatggtaatggagtggttacaaagaatggtggttacgtcagcggaatagcacaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacaactgacatttcagaaatgggggccaatttcaaagctgacagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcattggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgttttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggattgcgtcggctatagtcctggagttttttatgatggtgttgcttgtaccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggctgctattcacaagtgaacccactaactctaacagcggcagtactcttactgatcacacattatgccattataggtccaggattgcaggcaaaagccactcgtgaagctcagaaaaggacagccgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatctcccacctgaaaagtgtgacaccctgttgtgtgacattggagaatcttcaccaagcccaacagtggaagaaagcagaactataagagttttgaagatggttgaaccatggttaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtgtctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgagaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcaaagagtctttaaagagaaagtagacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaagcttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaaactaggctatatattaagggacatttccaaaatacccggaggagccatgtatgctgatgacacagctggttgggacacaagaataacagaagatgacctgcacaatgaggaaaagatcacacagcaaatggaccctgaacacaggcagttagcgaacgctatatttaagcttacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctggagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaagatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7477 - RNA, 9873 nt, synthetic construct
  misc_feature 1..9873: note = derived and/or modified CDS sequence (wt) from DENV-3__KF955456__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagctatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagctggaagctagaaaaagcatccctcatagaggtgaaaacctgcacatggccaaaatcacataccctttggagtaatggtgtgttagagagcgatatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactagtaatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagccattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaacttgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcaattcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaatatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7478 - RNA, 9873 nt, synthetic construct
  misc_feature 1..9873: note = derived and/or modified CDS sequence (wt) from DENV-3__KF955465__SS-prME
  source 1..9873: mol_type = other RNA
acatcgctctgtatcatgatgatactgccagcagcacttgctttccacttgacctcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatggtcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7479 - RNA, 9873 nt, synthetic construct
  misc_feature 1..9873: note = derived and/or modified CDS sequence (wt) from DENV-3__KF955466__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacgggtgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggagcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaactagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgagaaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacaatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatgcttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgattatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7480 - RNA, 9873 nt, synthetic construct
  misc_feature 1..9873: note = derived and/or modified CDS sequence (wt) from DENV-3__KF955468__SS-prME
  source 1..9873: mol_type = other RNA
acatcgctctgtctcatgatgatactgccagcagcacttgctttccacttgacctcacgagatggagagccgcgcatgattgtggggaagaatgaaagaggaaaatccctactttttaagacagcctctggaattaatatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtgacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcagggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattcttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaagggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcgcctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagctatgggagccgttttcacagaggagaaccaatgggacagcgcgaaagctgctgttgaggatgaggatttttggacacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatttaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtga

SEQ ID NO: 7481 - RNA, 9873 nt, synthetic construct
  misc_feature 1..9873: note = derived and/or modified CDS sequence (wt) from DENV-3__FJ744726__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaaaggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaaattttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccttcgatgaagagattcaggaaggaggaggagtcagagggagccatttggtaa

SEQ ID NO: 7482 - RNA, 9873 nt, synthetic construct
  misc_feature 1..9873: note = derived and/or modified CDS sequence (wt) from DENV-3__FJ744729__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctaaaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaacttgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgagatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccatcactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccttcgatgaagagattcaggaaggaggaggagtcagagggagccatttggtaa

SEQ ID NO: 7483 - RNA, 9873 nt, synthetic construct
  misc_feature 1..9873: note = derived and/or modified CDS sequence (wt) from DENV-3__FJ687448__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggacttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccctcgatgaagagattcaggaaggaggaggagtcagagggagccatttggtaa

SEQ ID NO: 7484 - RNA, 9873 nt, synthetic construct
  misc_feature 1..9873: note = derived and/or modified CDS sequence (wt) from DENV-3__FJ744732__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggacttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccattttacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgctgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccctcgatgaagagattcaggaaggaggaggagtcagagggagccatttggtaa

SEQ ID NO: 7485 - RNA, 9873 nt, synthetic construct
  misc_feature 1..9873: note = derived and/or modified CDS sequence (wt) from DENV-3__FJ810414__SS-prME
  source 1..9873: mol_type = other RNA
acatcgctctgtctcatgatgatgttaccagcaacacttgctttccacttgacttcacgtgacggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccactacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggacttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaagtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggcaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatactcacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgctcgtgagaaacccactctcacgaaactccacgcatgaaatgtactggatatccaatggtaccggcaacatcgtctcttcagtcaatatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccctcgatgaagagattcaggaaggaggaggagtcagagggagccatttggtaa

SEQ ID NO: 7486 - RNA, 9873 nt, synthetic construct
  misc_feature 1..9873: note = derived and/or modified CDS sequence (wt) from DENV-3__FJ744734__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggacttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaatgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccctcaatgaagagattcaggaaggaggaggagtcagagggagccatttggtaa

SEQ ID NO: 7487 - RNA, 9873 nt, synthetic construct
  misc_feature 1..9873: note = derived and/or modified CDS sequence (wt) from DENV-3__FJ744737__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggctgagataacaccccaggcatcaaccgtcgaagctatcttgcctgagtatggaacccttgggctagaatgctcaccacggacaggtttggacttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggggctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgaaaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagatttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcctatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctagactacatgccctcgatgaagagattcaggaaggaggaggagtcagagggagccatttggtaa

SEQ ID NO: 7488 - RNA, 9873 nt, synthetic construct
  misc_feature 1..9873: note = derived and/or modified CDS sequence (wt) from DENV-3__FJ744739__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagtttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatggctaagaacaagcctacgctggacatagagcttcagaagaccgaggccacccaactggcgaccctaaggaagttatgcattgaggggaaaattaccaacataacaactgactcaaggtgtcctacccagggggaagcgattttacctgaggagcaggaccagaactacgtatgtaagcacacatacgtggataggggttggggaaacggttgtggtttgtttggaaaaggaagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaactaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagcctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacacttcctcccttgagatacatgggagaggacggctgctggtatggcatggaaattagacctatcaatgagaaagaagagaacatggtaaagtctttagtctcagcagggagtggaaagatggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaactgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgctcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacctaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatgggaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggtaggaacccacaaaaagaaaatgaccagtacatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacctggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtagatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagcaaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcattcatcggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7489 - RNA, 9873 nt, synthetic construct
  misc_feature 1..9873: note = derived and/or modified CDS sequence (wt) from DENV-3__FJ744740__SS-prME
  source 1..9873: mol_type = other RNA
acatcgctctgtctcatgatgatgttaccagcaacacttgctttccacttgacttcacgtgatggagaaccgcgcatgattgtggcgaagaatgaaagagggaaatccctacttttcaagacagcttctggaatcaacatgtgcacactcatagccatggacttgggagagatgtgtgatgacacggtcacttacaaatgccccctcattgccgaagtggaacctgaagacattgactgctggtgcaaccttacatcgacatgggtgacctatggaacgtgcaatcaagctggggagcatagacgcgacaagagatcagttgcgttagctccccatgtcggcatgggactggacacacgcacccaaacctggatgtcggccgaaggagcttggagacaagtcgagaaggtagagacatgggcccttaggcacccaggtttcaccatactagctctatttcttgcccattacataggcacttccctgacccagaaagtggttatttttatactactaatgctggtcactccatccatgacaatgagatgtgtgggagtgggaaacagagattttgtggaaggtctgtcgggagctacgtgggttgatgtggtgctcgagcacggtgggtgcgtgactaccatagctaagaacaagcccacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaagggagcttggtgacatgcgcgaaatttcaatgtctagaaccaatagagggaaaagtggtgcaacatgagaacctcaaatacactgtcatcatcacagtgcacacaggagaccaacaccaggtgggaaatgacacgcagggagtcacggttgagataacaccccaggcatcaaccgtcgaagctatcttgcctgagtatggaacccttgggctagaatgctcaccacggacaggtttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtagttgtccttggatcgcaagagggagcaatgcacacagcgttgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagactgatcacagccaacccagtggttactaagaaggaggagcctgtcaacattgaggctgaacctccttttggggaaagcaacatagtgattggagttggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtttcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacagacccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagttgatacacgaatggtgttgccgctcgtgcacgcttcctcccttgagatacatgggagaggacggctgctggtatggcatggaaattagacctatcaatgagaaagaagagaacatggtaaagtctttagtctcagcagggagtggaaaggtggacaacttcacaatgggaatcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacatttaaaatccagccattcttggccttgggattctttctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtctcaggcatctttccatactccatacccgccacactgttggtctggcatacttggcaaaagcaaacccaaagatctggcgttctatgggatgtacctagccccccagaaacacagaaagcagaactggaagagggggtctataggatcaaacaacaaggaatttttgggaaaacccaagtaggggttggagtgcagaaagaaggagtcttccacaccatgtggcacgtcacaagaggggcagtattgacgcacaatggaaaaagactggaaccaaactgggctagcgtgaaaaaagatctgatttcatacggaggaggatggagattgagtgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaaccataatggatctccatcctgggtcaggaaagacgcggaaatatcttccagccatcgtcagagaagcaatcaagagacgcttaagaactctaattttggcgccaacaagagtggttgcagctgagatggaagaagcactgaaaggactcccaataaggtatcaaacaactgcaataaaatctgaacacacaggaagggagattgttgatctaatgtgccacgcaacgttcacaatgcgcttgctgtcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgccgaagcctttcctcagagcaacgctccaattcaagatgaagaaagggacattccggaacgctcatggaattcaggcaatgaatggatcaccgactttgttgggaagacggtgtggtttgtccctagcatcaaagccggaaatgacatagcaaattgtctgcgaaaaaatggaaaaaaggtcatccaacttagtaggaagacttttgatacagaatatcaaaagaccagactgaatgattgggacttcgtggtgacaacagatatttcagaaatgggagctaactttaaagcagatagagtgattgacccaagaagatgtctcaagccagtaattttaacagatggacccgagcgggtgatcctggctggaccaatgccagtcaccgcagcgagcgctgcacaaaggagagggagagttggcaggaaccctcaaaaggaaaatgaccagtatatattcacgggccagcctctcaacaatgacgaagaccatgctcactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcatcagaaggaatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttactcagatcccttagcactcaaggaattcaaggattttgcagctggcagaaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcttggaatttttcatgatggtgttgctcataccagaaccagaaaaacagagaactccccaagacaaccaactcgcatatgtcgtgataggcatacttacactggctgcgatagtaacagccaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacctaggcgtaccgctactggcattgggctgctattcacaagtgaacccattgactctcacagcggcagtacttctgctagttacacattatgccattataggtccaggattgcaggctaaagccactcgtgaagctcaaaaaaggacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccctgtgtgaagctctaaccctggccacaggaccaataacaacactctgggaaggatcacccggaaagttttggaacaccacgatagctgtttccatggctaacatctttagagggagctacttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggacagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatactactgcgcaggactgaaaaaagttacagaagtgcgaggatacacaaaaggcggcccaggacacgaagaaccagtacctatgtctacatacggatggaacatagttaagctaatgagtggaaaggacgtgttttatcttccacccgaaaagtgtgacaccctattgtgtgacattggagaatcttcaccaagcccaacagtggaagaaagcagaactataagagttttaaagatggttgagccatggctaaaaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacatgggcttaccatggatcctatgaagtcaaagccacaggctcagcctcctccatgataaatggagtcgtgaaactcctcacaaaaccatgggatgtggtgcccatggtgacacagatggcaatgacagatacaactccatttgggcagcaaagagttttcaaagagaaagtggacaccaggacacccaggcccatgccagggacaagaaaggttatggagatcacagcggaatggctttggagaactctgggaaggaacaaaagacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagagcgtgaactccacaaattaggcaagtgtggaagctgcgtctacaacatgatgggcaagagagagaagaaacttggagagtttggcaaagccaaaggcagtagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagctatgtatgctgatgacacagctggttgggacacaagaataacagaagatgacctgcacaatgaggaaaaaatcacacagcaaatggatcctgaacatagacaattagcgaacgccatatttaagctcacatatcaaaacaaagtggtcaaagttcaacgaccaactccaaaaggcacggtaatggacattatatctaggaaagaccaaagaggcagtggacaggtggggacttatggtctgaacacattcaccaacatggaagctcagttagtcagacagatggaaggagaaggcgtgttgtcgaaggtagacctcgagaaccctcatctgctagagaagaaaatcacacaatggttggaaaccaaaggagtggagagattaagaagaatggccatcagcggggatgattgcgtggtgaaaccgatcgatgacaggtttgccaatgccctgctcgccctgaacgacatgggaaaggttaggaaggacatacctcaatggcagccatcaaagggatggcatgattggcaacaggtccctttctgctcccaccactttcatgaactgatcatgaaagatggaagaaagttggtggttccctgcagaccccaggacgaactaataggaagagcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattgggtccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcatcggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7490 - RNA, 9873 nt, synthetic construct
  misc_feature 1..9873: note = derived and/or modified CDS sequence (wt) from DENV-3__GQ868593__SS-prME
  source 1..9873: mol_type = other RNA
acatcgctctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagccatggacttgggagagatgtgtgatgacacggtcacttacaaatgcccccacattgccgaagtggaacctgaagacattgactgctggtgcaaccttacatcgacatgggtgacttatggaacgtgcaatcaagctggggagcacagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagctctatttcttgcccattacataggcacttccttgacccagaaagtggttatttttatactactaatactggtcactccatccatggcaatgagatgcgtgggagtaggaaacagagattttgtggaaggtctatcgggagctacgtgggttgacgtggtgctcgagcacggtgggtgtgtgaccaccatggctaagaacaagcccacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcatacatacgtggatagaggctggggaaacggttgtggtttgtttggaaaaggaagcttggtgacatgcgcgaaatttcaatgcttagaatcaatagagggaaaagtggtgcaacatgagaacctcaaatacactgtcatcattacagtgcacacaggagaccaacaccaggtgggaaatgaaacgcagggagtcacggctgagataacaccccaggcatcaaccgttgaagctatcttgcctgaatatggaacccttgggctagaatgctcaccacggacaggtttggatttcaatgaaatgatcttattgacaatgaagaacaaagcatggatggtacatagacaatggttctttgacctacccctaccatggacatcaggagctacaacagagacaccaacttggaacaggaaagagcttcttgtgacattcaaaaatgcacatgcaaaaaagcaagaagtagttgtccttggatcgcaagagggagcaatgcacacagcgctgacaggagctacagagatccaaaactcaggaggcacaagcatttttgcggggcacttgaaatgtagacttaagatggacaaattggaactcaaggggatgagctatgcaatgtgcttgaacacctttgtgttgaagaaagaagtctccgagacgcagcatgggacaatactcattaaggttgagtacaaaggggaagatgcaccttgcaagattcctttctccacggaggatggacaagggaaagctcacaatggtagactgatcacagccaacccagtggtgaccaagaaggaggagcctgtcaacattgaggctgaacctccttttggggaaagtaacatagtgattggaattggagacaaagccttgaaaattaactggtacaagaagggaagctcgattgggaagatgttcgaggccactgccagaggtgcaaggcgcatggccatcttgggagacacagcctgggactttggatcagtgggtggtgttctgaattcattagggaaaatggtgcaccaaatatttggaagtgcttacacagccctgtttagtggagtctcatggataatgaaaattggaataggtgtcctcttaacctggatagggttgaattcaaaaaacacttccatgtcattttcatgtattgcgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccccaaaagactggcgacagccattgcaggcgcctgggaaaatggagtctgtggaatcaggtcaacaaccagaatggagaatctattgtggaagcaaatagccaatgaactgaactacatattatgggaaaacaacatcaaattaacggtagtggtgggcgacataattggggtcttagagcaagggaaaagaacactaacaccacaacccatggagctaaaatattcatggaaaacatggggaaaagcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaattgtgcgaccataggctaatgtcagcagccgtcaaagatgagagggccgtgcatgccgacatgggctattggatagaaagccaaaagaatggaagttggaagctagaaaaagcatccctcatagaggtaaaaacctgcacttggccaaaatcacacactctttggagtaatggtgtactagagagtgacatgatcatcccaaagagtctagctggtcctatttcgcaacacaaccacaggcccgggtaccacacccaaacggcaggaccctggcacttgggaaaattggagctggacttcaactattgtgaaggaacaacagttgtcatcacagaaaactgtgggacaagaggcccatcattgagaacaacaacagtgtcggggaagttgatacacgaatggtgttgccgctcgtgcacacttcctcccttgcgatacatgggagaagacggctgctggtatggcatggaaattagacccatcaatgagaaagaagagaacatggtaaagtctttagcctcagcagggagtggaaaggtggacaacttcacaatgggtgtcctgtgtttggcaatcctcttcgaagaggtgatgagaggaaaatttgggaaaaaacacatgattgcaggggttctcctcacgtttgtgctccttctctcagggcaaataacatggagagatatggcgcacacactcataatgattgggtccaacgcttctgacaggatgggaatgggcgttacctacctagctttaattgcaacatttaaaatccagccattcttggctttgggattcttcctgaggaaattgacatctagagaaaatttactgttgggagttgggttggccatggcaacaacgttacaactgccagaggacattgaacaaatggcgaatggaattgctctggggctcatggctcttaaactgataacacaatttgagacataccagttatggacggcattagtctccctaacgtgttcaaatacaattttcacgttgactgttgcctggagaacagccaccttgattctggccggagtttcgcttttgccagtgtgccagtcttcgagcatgaggaaaacagattggctcccaatggctgtggcagctatgggagttccacccttaccacttttcatcttcagcttgaaagatacactcaaaaggagaagctggccactgaatgagggggtgatggctgttgggcttgtgagcattctagctagctctctccttaggaatgatgtgcccatggctggaccattagtggccgggggcttgctgatagcgtgctacgtcataactggcacgtcagcggacctcactgtagaaaaagcagcagatgtaacatgggaggaagaggctgagcaaacaggagtgtcccacaatttgatgatcacagttgatgatgatggaacaatgagaataaaagatgatgagactgagaacatcctaacagtgctcttaaaaacagcattactaatagtatcaggcatctttccatattccatacccgccacactgttggtctggcatacttggcaaaagcaaacccaaagatctggcgttctatgggacgtacccagccccccagaaacacagaaagcagaactggaagagggggtctataggatcaaacagcaaggaatttttgggaaaacccaagtgggggttggagtacagaaagaaggagtcttccataccatgtggcacgtcacaagaggggcagtgttgacgcacaatgggaaaagattggaaccaaactgggccagcgtgaaaaaagatctgatttcatacggaggaggatggagattgagtgcacaatggcaaaagggagaggaggtgcaggttattgccgtagagcccgggaagaacccaaagaactttcaaaccatgccgggcatttttcagacaacaacaggggaaataggagcaattgcactagacttcaagcctggaacttcaggatctcctatcataaacagagagggaaaggtagtgggactgtatggcaatggagtggttacaaagaatggtggctacgtcagtggaatagcgcaaacaaatgcagaaccagacggaccgacaccggagttggaagaggagatgttcaaaaagcgaaatctaaccataatggatcttcatcctgggtcaggaaagacgcggaaatatcttccagctatcgtcagagaagcaatcaagagacgcttaagaactctaattttggcaccaacaagggtggttgcagctgagatggaagaagcattgaaagggctcccaataaggtatcaaacaactgcaacaaaatctgaacacacaggaagggagattgttgatctaatgtgccacgcaacgttcacaatgcgcttgctatcaccagtcagggttccaaattacaatttgataataatggatgaggcccatttcacagatccagccagtatagcggctagagggtacatatcaactcgtgtaggaatgggagaggcagctgcaatcttcatgacagcaacaccccctggaacagccgatgcctttcctcagagcaacgctccaattcaagatgaagaaagggatatcccggaacgctcatggaattcaggcaatgaatggattaccgactttgttgggaagacggtgtggtttgtccccagcatcaaagccggaaatgacatagcaaactgcttgcggaaaaatggaaaaaaggtcattcaacttagtaggaagacttttgatacagaatatcaaaagaccaaactgaatgattgggacttcgtggtgacaacagacatttcagaaatgggagccaactttaaagcagatagagtgatcgacccaagaagatgtctcaagccagtgattttgacagatggacccgagcgggtgatcctggctggaccaatgccagtcactgcagcgagcgctgcgcaaaggagagggagagttggcaggaacccacaaaaagaaaatgaccagtacatattcacgggccagcctctcaacaatgacgaagaccatgctcactggacagaagcaaaaatgctgctggacaacatcaacacaccagaagggattataccagctctctttgaaccagaaagggagaagtcagccgccatagacggtgaataccgcctgaagggtgagtccaggaagaccttcgtggaactcatgaggaggggtgacctcccagtttggctagcccataaagtagcatcagaagggatcaaatatacagatagaaaatggtgctttgatggagaacgtaataatcaaattttagaggagaacatggatgtggaaatctggacaaaggaaggagaaaagaaaaaattgagacctaggtggcttgatgcccgcacttattcagatcccttggcactcaaggaattcaaggattttgcagctggcagaaagtcaatcgcccttgatcttgtgacagaaataggaagagtgccttcacatttagcccacagaacgagaaacgccctggacaatttggtgatgctgcacacgtcagaacatggcggtagggcctacaggcatgcagtggaggaactaccagaaacaatggaaacactcctactcttgggactcatgatcttgttaacaggtggagcaatgctgttcttgatatcaggtaaagggattggaaagacttcaataggactcatctgtgtaattgcttccagtggcatgttatggatggccgatgtcccacttcaatggatcgcgtcggctatagtcctggaatttttcatgatggtgttgcttataccagaaccagaaaagcagagaactccccaagacaaccaactcgcatatgtcgtgataggcatacttacactggctgcaatagtagcagccaatgaaatgggactgttggaaactacaaagagagatttaggaatgtctaaagaaccaggtgttgtttctccaaccagctatttagatgtagacttgcacccagcatcagcctggacattgtacgctgtggccacaacagtaataacaccaatgttgagacataccatagagaattccacagcaaatgtgtccctggcagctatagctaaccaggcagtggtcctgatgggcttagacaaaggatggccaatatcgaaaatggacttaggcgtaccactactggcactgggctgctattcacaagtgaacccactgactctcacagcggcagtacttttgctagctacacattatgctattataggtccaggattgcaggcaaaagccactcgtgaagctcaaaaaaggacagctgctggaataatgaagaatccaacggtggatgggataatgacaatagacctagatcctgtaatatacgattcaaaattcgaaaagcaactaggacaggttatgctcctagttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaagagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaataacacgtcatgccgtgtccagaggcagcgcaaaacttcaatggttcgtggagaggaacatggtcattcccgaaggaagagtcatagacttaggctgtggaagaggaggctggtcatattactgcgcaggattgaaaaaagttacagaagtgcgaggatacacaaaaggcggcccaggacacgaagaaccagtacctatgtctacatacggatggaacatagtcaagttaatgagtggaaaggatgtgttttatctcccacctgaaaagtgtgacaccctattgtgtgacattggagaatcttcaccaagcccaacagtggaagaaagcagaactataagagttttgaagatggttgaaccatggctaaaaaataaccagttttgcattaaagtattaaacccttacatgccaactgtgattgagcacctagaaagactacaaaggaaacatggaggaatgcttgtgagaaatccactctcacgaaactccacgcacgaaatgtactggatatccaatggtaccggcaacatcgtctcttcagtcaacatggtatccagattgctactgaacagatttacaatgacacacaggagacccaccatagagaaagatgtggatttgggagcaggaacccgacatgtcaatgcggaaccagaaacacccaatatggacgtcattggagaaagaataaaaaggatcaaggaggagcataattcaacatggcactatgatgatgaaaatccttacaaaacgtgggcttaccatggatcctatgaagtcaaagccacaggctcagcctcctccatgataaatggagtcgtgaaactcctcacaaaaccatgggatgtggtgcccatggtgatacagatggcaatgacagatacaactccatttgggcagcaaagagttttcaaagagaaagtggacaccaggacacccaggcccatgccagggacaagaaaggttatggagatcacagcggaatggctttggagaaccctgggaaggaacaaaagacccagattgtgcacaagggaagagttcacaaaaaaggtcagaaccaacgcggctatgggcgccgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagccaggtaccttgagttcgaggcactcggattcttaaatgaagaccactggttctcgcgtgaaaactcttacagtggagtagaaggagaaggactgcacaagctgggatacattttaagagatatttccaagatacccggaggagctatgtatgctgatgacacagctggttgggacacaagaataacagaagatgacctgcacaatgaggaaaaaatcacacagcaaatggaccctgaacacagacagttagcgaacgccatattcaagctcacataccaaaacaaagtggtcaaagttcaacgaccaactccaaaaggcacggtaatggacatcatatctaggaaagaccaaagaggcagtggacaggtggggacttatggtctgaatacattcaccaacatggaagcccagttagtcagacagatggaaggagaaggcgtgttgtcgaaggcagaccttgagaatcctcatctgctagagaagaaaatcacacaatggttggaaaccaaaggagtggagaggttaaaaagaatggctatcagtggggatgattgcgtagtgaaaccgatcgacgacaggtttgccaatgccctgcttgccctgaacgatatgggaaaggttaggaaggacatacctcaatggcagccatcaaagggttggcatgattggcaacaggtccctttctgctcccaccactttcatgaactgatcatgaaagatggaagaaagttggtggttccctgcagaccccaggacgaactaataggaagagcgagaatctctcaaggagcaggatggagccttaaagaaactgcatgtctagggaaagcctacgctcaaatgtggagtctcatgtattttcacagaagagatcttagactagcatccaacgccatatgttcagcagtaccagtccattgggtccctacaagcagaacgacatggtctattcatgctcaccatcagtggatgactacagaagacatgcttactgtctggaacagggtgtggatagaggacaatccatggatggaagacaaaactccagtcacaacttgggaagatgttccatacctagggaagagagaagaccaatggtgcggatcactcatcggtctcacttccagagcaacctgggcccagaacatactcacagcaatccaacaagtgagaagccttataggcaatgaagagtttctggactacatgccttcgatgaagagattcaagaaggaggaggagtcagagggagccatttggtaa

SEQ ID NO: 7491 - RNA, 9873 nt, synthetic construct
  misc_feature 1..9873: note = derived and/or modified CDS sequence (wt) from DENV-3__FJ898459__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggagaagatgcaccttgcaagattcctttctctacagaggatggacaagggaaagctcacaatggcagactgattacagccaacccagtggtgactaagaaggaggagcctgtcaatattgaggctgaacctccttttggggaaagtaatatagtgattggaattggagacaacgccttaaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacctatggagctaaaatactcatggaaaacgtggggaaaggcaaaaatagtgacagctgaaacacaaaattcttctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgcgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgctagagagtgacatgatcatcccaaagagtctagctggtcctatttcgcaacacaaccacaggcccgggtaccacacccagacggccggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgttggtatggcatggaaatcagacccattagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaagtccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccaccactaccactctttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcaccctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagatggtgagtatcgcttgaaaggtgagtctaggaagaccttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgaccttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatctggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggacagaacagaagccaaagaaggattgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgttactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttctggaaacttgtggacagagaacgtgaactccacaaattgggcaagtgtggaagctgtgtttacaacatgatgggcaagagagagaagaaacttggagagtttggcaaagcaaaaggtagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccgcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggtaatgaagagtttctggactacatgccttcaatgaagagatttaggaaggaggaggagtcggagggagccatttggtaa

SEQ ID NO: 7492 - RNA, 9873 nt, synthetic construct
  misc_feature 1..9873: note = derived and/or modified CDS sequence (wt) from DENV-3__EU482555__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggcgcttaaactgataacacaatttgaaacataccaattatggacagcattaatctccttaacgtgttcaaatacaatgtttacgttgactgttgcctggagaacagccaccctgattttggccggagtttcgcttttaccagtgtgtcagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcacacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagattacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagttaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatttagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7493 - RNA, 9873 nt, synthetic construct
  misc_feature 1..9873: note = derived and/or modified CDS sequence (wt) from DENV-3__EU529692__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgactctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctgttgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggccggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagtccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7494 - RNA, 9873 nt, synthetic construct
  misc_feature 1..9873: note = derived and/or modified CDS sequence (wt) from DENV-3__EU482558__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggataaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcctgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacacatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7495 - RNA, 9873 nt, synthetic construct
  misc_feature 1..9873: note = derived and/or modified CDS sequence (wt) from DENV-3__EU482563__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtataaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacttagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatctttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaaggtatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagagaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacagggccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtaaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggagaagatcacacagcaaatggaccctgaacacaggcagctagctaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7496 - RNA, 9873 nt, synthetic construct
  misc_feature 1..9873: note = derived and/or modified CDS sequence (wt) from DENV-3__EU529696__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgactctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgttcttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagtcccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacacgaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctgttgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggccggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggtaatgaagagtttctggactacatgccttcaatgaagagatttaggaaggaggaggagtcggagggagccatttggtaa

SEQ ID NO: 7497 - RNA, 9873 nt, synthetic construct
  misc_feature 1..9873: note = derived and/or modified CDS sequence (wt) from DENV-3__EU529697__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacccacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttgaacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagtgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7498 - RNA, 9873 nt, synthetic construct
  misc_feature 1..9873: note = derived and/or modified CDS sequence (wt) from DENV-3__EU482564__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacattggatatagagcttcagaagaccgaggccacccaattggcgactctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaacttaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaatacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagacctggacttcaactattgcgaaggaacaacagttgtcatcacagaaaactgtgggacaagacgcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctgttgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggccggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7499 - RNA, 9873 nt, synthetic construct
  misc_feature 1..9873: note = derived and/or modified CDS sequence (wt) from DENV-3__EU529699__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattatataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagaaggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccgtcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagtggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctatccatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacctacagcaattcaacaggtgagaagccttataggcaatgaagagtttctggactacatgccttcaatgaagagatttaggaaggaggaggagtcggagggagccatttggtaa

SEQ ID NO: 7500 - RNA, 9873 nt, synthetic construct
  misc_feature 1..9873: note = derived and/or modified CDS sequence (wt) from DENV-3__EU482566__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaaaaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7501 - RNA, 9873 nt, synthetic construct
  misc_feature 1..9873: note = derived and/or modified CDS sequence (wt) from DENV-3__EU529702__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttacggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgcaagcatacatacgtagacagaggctgggggaacggatgtggtttatttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacaatggcagactgatcacagccaacccagtggtgactaagaaggaggagcctgtcaatattgaggctgaacctccttttggggaaagtaatatagtgattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactaaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttctcaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgccttgtgtttggcaatcctctttgaagaggtgatgagaggaaaatttgggaagaaacacatgattgcgggggttttctttacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattattaggagttgggctggctatggcaacaacgttacaactgccagaggacattgaacaaatggcaaacggaatcgctctggggctcatggctctcaaactgataacacaatttgaaacataccagttatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagggagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgtcagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagcaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaaggaatcataccagctctctttgagccagaaagggagaagtcagccgccatagacggtgagtatcgtctgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacacttctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagtagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggacacttgtggacagagaacgtgagctccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacagatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7502 - RNA, 9873 nt, synthetic construct
  misc_feature 1..9873: note = derived and/or modified CDS sequence (wt) from DENV-3__EU529703__SS-prME
  source 1..9873: mol_type = other RNA
acatcgctctgtctcatgatgatattgccagcagcacttgctttccacctgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattactgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaagagcaggaccagaactacgtgtgtaagcatacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaaggaatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacatactatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagccatgtatgctgatgacacagccggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccatcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctaggaaagagagaagaccagtggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7503 - RNA, 9873 nt, synthetic construct
  misc_feature 1..9873: note = derived and/or modified CDS sequence (wt) from DENV-3__EU529705__SS-prME
  source 1..9873: mol_type = other RNA
acatcgctctgtctcatgatgatactgccagcagcactcgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggaataggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagatagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaataggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattgggactcaaggggatgagctatgcaatgtgcacgaatacctttgtgttgaagaaagaagtctcggaaacgcagcatgggacaatactcatcaaggtcgagtacaaaggggaagatgtaccttgcaaggttcctttctccacagaggatggacaagggaaagctcacagtggcagactgattacagccaacccagtggtgactaagaaggaggagcctgttaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggaattctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggaactaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattggatccaacgcatctgacaggatgggaatgggcgtcacctacctagctttaattgcaacatttaaaatccagccattcttggctttgggattttttctaagaaaactgacatccagagaaaatttattattaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctactcagatcccctagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacacttctactcctaggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacgaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtgtctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgagcgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7504 - RNA, 9873 nt, synthetic construct
  misc_feature 1..9873: note = derived and/or modified CDS sequence (wt) from DENV-3__EU596492__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttgtaaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttgaacaaaggatggccaatatcaaaaatggacttaggagtacccctgctggcattaggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatgcctcaatggcagccatcaaagggatggcatgattggcagcaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7505 - RNA, 9873 nt, synthetic construct
  misc_feature 1..9873: note = derived and/or modified CDS sequence (wt) from DENV-3__EU596493__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcactaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgaacgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaacttgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaatatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7506 - RNA, 9873 nt, synthetic construct
  misc_feature 1..9873: note = derived and/or modified CDS sequence (wt) from DENV-3__EU596494__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagggattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggatccacagaaatccaaaactcaggaggcacaagcatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtaaaaacctgcacatggccaaaatcacataccctttggagtaatggtgtgttagagagcgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaagtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacgagggtggttgcagctgagatggaagaagcattaaaagggctcccaataaggtaccaaacaacagcaacaagatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaggatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggataatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtctggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactattgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcaccgaagtggatagaacagaagccaaagaagggttgaaaagaggagaaataacacatcatgccgtgtccagaggtagcgcaaaacttcaatggtttgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtgcctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgtacaagggaagagtttacaaaaaaggtcagaactaatgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgatacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccattttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7507 - RNA, 9873 nt, synthetic construct
  misc_feature 1..9873: note = derived and/or modified CDS sequence (wt) from DENV-3__EU687218__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagaaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7508 - RNA, 9873 nt, synthetic construct
  misc_feature 1..9873: note = derived and/or modified CDS sequence (wt) from DENV-3__EU726772__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagtcttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaagggtcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7509 - RNA, 9873 nt, synthetic construct
  misc_feature 1..9873: note = derived and/or modified CDS sequence (wt) from DENV-3__FJ182013__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcattacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatttgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagttcctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7510 - RNA, 9873 nt, synthetic construct
  misc_feature 1..9873: note = derived and/or modified CDS sequence (wt) from DENV-3__EU781136__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccggataccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacggtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagtccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacgggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7511 - RNA, 9873 nt, synthetic construct
  misc_feature 1..9873: note = derived and/or modified CDS sequence (wt) from DENV-3__EU781137__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtagaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcttcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaagatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattggtcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7512 - RNA, 9873 nt, synthetic construct
  misc_feature 1..9873: note = derived and/or modified CDS sequence (wt) from DENV-3__EU726773__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggggaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtgcccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7513 - RNA, 9873 nt, synthetic construct
  misc_feature 1..9873: note = derived and/or modified CDS sequence (wt) from DENV-3__EU726774__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatggttgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacgatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7514 - RNA, 9873 nt, synthetic construct
  misc_feature 1..9873: note = derived and/or modified CDS sequence (wt) from DENV-3__EU687219__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgtctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagctaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtgattacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgacctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtacgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaggcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7515 - RNA, 9873 nt, synthetic construct
  misc_feature 1..9873: note = derived and/or modified CDS sequence (wt) from DENV-3__EU726768__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaacttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaggatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcctaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7516 - RNA, 9873 nt, synthetic construct
  misc_feature 1..9873: note = derived and/or modified CDS sequence (wt) from DENV-3__EU687226__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgctttgaaaatcaactggtacaagaagggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtttgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccgtcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgatagcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattgatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactctttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcacaagcaaacccaaagatccggcgttccatgggatgtacccagccctccagagacacagaaagcagaactggaagaaggggtctataggatcaaacagcaaggaatttttgggaaaacccaagtaggggttggagtacagaaagaaggagtcttccactccatgtggcacgttacaagaggggcagtgttgacatataatgggaaaagactggaaccaaactgggctagcgtgaagaaagatctgatttcatacggaggaggatggagattgagcgcacaatggcaaaagggggaggaggtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggattatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattaatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7517 - RNA, 9876 nt, synthetic construct
  misc_feature 1..9876: note = derived and/or modified CDS sequence (wt) from DENV-3__EU687233__SS-prME
  source 1..9876: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccatggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctatcataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatgtcactcaaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7518 - RNA, 9873 nt, synthetic construct
  misc_feature 1..9873: note = derived and/or modified CDS sequence (wt) from DENV-3__EU687234__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacagtggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggaactaaaatactcatggaaaacgtggggaaaggcaaaaatagtgacagctgaaacacaaaattcttccttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattggatccaacgcatctgacaggatgggaatgggcgtcacctacctagctttaattgcaacatttaaaatccagccattcttggctttgggattttttctaagaaaactgacatccagagaaaatttattattaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacacttctactcctaggactcatgatcttgttgacaggtggagcaatgctattcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgagcgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7519 - RNA, 9873 nt, synthetic construct
  misc_feature 1..9873: note = derived and/or modified CDS sequence (wt) from DENV-3__EU687196__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaaaaccgaggccacccaactggcgaccctaaggaagctatgcattgaggggaaaattaccaacataacaactgactcaagatgtcccacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacagtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatctctcatagaggtgaaaacctgcacatggccaaaatcacatactctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttatcttcacgtttgtactccttctctcagggcaaataacatggagagatgtggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttaggaatgatgtgcccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagacctgatttcatacggaggaggatggagattgagcgcacaatggcaaaagggggaggaggtgcaggttattgccgtagagcctgggaaaaatccaaagaactttcaaaccatgccaggcatttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgcagcgcaaaggagagggagagttggcaggaacccacaaaaagaaaatgaccagtacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatatgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaactagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagagggggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactgtaagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcatatttcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttctggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagctttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7520 - RNA, 9873 nt, synthetic construct
  misc_feature 1..9873: note = derived and/or modified CDS sequence (wt) from DENV-3__EU854298__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgtccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggtcatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgttgacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacggtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcctacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgcatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctttttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccgcctctaccactttttatttttagcttgaaagacacactcaaaaggagaagctggccattgaatgaaggggtgatggctgttgggcttgtgagcattctggccagttctctccttagaaatgatgtacccatggctggaccattagtggccgggggcttgctgatagcgtgctacgtcataactggcacatcagcagacctcaccgtagaaaaagcagcagatgtaacatgggaggaagaggctgagcaaacaggagtgtcccataacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttggcatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccataccaggcacttttcagactacaacaggggaaataggagcaattgcactggatttcaagcctggaacctcaggatctcccatcataaacagagagggaaaggtagtgggactgtatggcaatggagtggttacaaagaatggtggctacgtcagcggaatagcgcaaacgaatgcagaaccagatggaccaacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaacaatcaaattttagaagagaacatggacgtggaaatttggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattacgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaggtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcactaacatggaagtccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcatcaggtgagaagccttataggcaatgaagagtttctggactacatgccttcaatgaagagatttaggaaggaagaggagttggagggagccatttggtaa

SEQ ID NO: 7521 - RNA, 9873 nt, synthetic construct
  misc_feature 1..9873: note = derived and/or modified CDS sequence (wt) from DENV-3__FJ373306__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccactatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgcaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttctcaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattattaggagttgggctggctatggcaacaacgttacaactgccagaggacattgaacaaatggcaaacggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgtctgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacacttctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatccagtgatatatgattcaaaatttgaaaagcaactgggacaggttatgctcctggttttgtgtgcagttcaacttttattaatgagaacatcatgggccttgtgtgaagctttaactctagccacaggaccaataacaacactctgggaaggatcacctgggaagttttggaacaccacgatagctgtttccatggcgaacatctttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagtcttgaagatggttgaaccatggctaaagaacaaccaattttgtattaaagtattgaacccttacatgccaactgtgattgagcacctagaaagattacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgagctccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7522 - RNA, 9873 nt, synthetic construct
  misc_feature 1..9873: note = derived and/or modified CDS sequence (wt) from DENV-3__EU687197__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggtcatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagactgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgttgacagaggctgggggaacggatgtggtttgtttggcaagggaagcttggtaacatgtgcgaaatttcaatgcctggaaccaatagagggaaaagtggtgcaatatgagaaccttaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaacacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttgtaaactggaaaggcaaagaactcaaatgtggaagtggaatcttcgtcaccaacgaggtccatacctggacagagcaatacaaattccaagcagactccccgaaaagattggcgacagccattgcaggcgcctgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcgtggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccgcctctaccactttttatttttagcttgaaagacacactcaaaaggagaagctggccattgaatgaaggggtgatggctgttgggcttgtgagcattctggccagttctctccttagaaatgatgtacccatggctggaccattagtggccgggggcttgctgatagcgtgctacgtcataactggcacatcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttggcatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacctcaggatctcccatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaaggactcccaataaggtaccaaacaacagcaacaaaatctgaacacacaggaagagagattgttgatctgatgtgccatgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggagaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagatggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaacaatcaaattttagaagagaacatggatgtggaaatctggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgcactggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaatcgcttccagcggcatgttgtggatggccgaaatcccactccaatggattgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagcgagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattacgctattattggtccaggattgcaggcaaaagccactcgtgaagctcagaaaaggacagctgctggaataatgaagaatccaacggtggatgggataatgacaatagacctagatcccgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcaccgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaggtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcactaacatggaagtccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcatcaggtgagaagccttataggcaatgaagagtttctggactacatgccttcaatgaagagatttaggaaggaagaggagttggagggagccatttggtaa

SEQ ID NO: 7523 - RNA, 9873 nt, synthetic construct
  misc_feature 1..9873: note = derived and/or modified CDS sequence (wt) from DENV-3__EU687198__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtaggaaatgaaacgcagggagtcacggctgagataacacctcaggcatcaaccactgaagccatcttacctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacttggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggagttggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatgggatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttgccagtgtgccagtcttcgagcatgaggaaatcagactggcttccaatgacagtggcagctatgggagttccacctctaccactttttatttttagcttgaaggacacactcaaaagaagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtgcagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactatatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactagactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcttggttttgtgtgcagttcaacttctgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagttcacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcggacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7524 - RNA, 9873 nt, synthetic construct
  misc_feature 1..9873: note = derived and/or modified CDS sequence (wt) from DENV-3__EU726769__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccactacataggcacttccttgacccagaaggtggttatttttatactactaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaataaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtttagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatggttgcgggggttttcttcacgtttgtactccttctctcagggcaaataacatggagagatatggcgcacacactaataatggttgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgtcagtcttcgagcatgaggaaaacagactggcttccaatgacggtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatccttacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagagctggaagaaggggtctataggatcaaacagcaaggaatttttgggaaaacccaagtgggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgttcccagcattaaagccggaaatgacatagcaaactgcttgcgaaaaaacgggaaaaaggtcattcaacttagtaggaagacttttgatacagaatatcagaaaactaaactgaatgattgggacttcgtggtgacgactgacatttcagaaatgggggccaatttcaaagcagatagagtgatcgaccctagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccctcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatagccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttctgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcctgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacggaactccacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaagtgggcaagtgtggaagctgtgtttacaacatgatgggcaagagagagaagaaacttggagagtttggcaaagcaaaaggcagtagagctatatggtacatgtggttgggagccaggtacctcgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7525 - RNA, 9873 nt, synthetic construct
  misc_feature 1..9873: note = derived and/or modified CDS sequence (wt) from DENV-3__EU687239__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggtacaagcatttttgcggggcacttaaagtgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggagttggagacaacgccttgaaaatcaactggtacaagaagggaagctctattgggaagatgtttgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaagaagaagttggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaattggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcagttgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataatttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgttatatatgattcaaaatttgaaaagcaactgggacaggttatgctcctggttttgtgtgcagttcaacttttgttaatgagaacatcatgggccttgtgtgaggctttaactctagctacaggaccaataacaacactctgggaaggatcacctgggaagttttggaacaccacgatagctgtttccatggcaaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattgagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagtcatttggtaa

SEQ ID NO: 7526 - RNA, 9873 nt, synthetic construct
  misc_feature 1..9873: note = derived and/or modified CDS sequence (wt) from DENV-3__FJ182004__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgaaaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7527 - RNA, 9873 nt, synthetic construct
  misc_feature 1..9873: note = derived and/or modified CDS sequence (wt) from DENV-3__FJ024465__SS-prME
  source 1..9873: mol_type = other RNA
acatcgctctgtctcatgatgatattgccagcagcacttgctttccacttgacttcacgagatggagagccgcgtatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacccctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgtattgcgataggaatcattacactctatctgggagctgtggtgcaagctgacacggggtgtgttataaactggaaaggaaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaagtgaaaacctgcacatggccaaaatcacataccctttggagtaatggtgtgttagagagtgacatgatcattccaaagagtctagctggtcctatctcgcaacacaactataggcccgggtaccacacccagacggcgggaccctggcatttaggaaaattagagctggacttcaactattgtgaagggacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggcgttttcttcacgtttgtactccttctctcagggcaaataacatggagagatatggcgcacacactaataatgattgggtccaacgcatctgacaggatgggaatgggcgttacctacctagctttaattgcaacatttaaaatccaaccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgacgtacccatggctggaccattagtggccgggggcttgctgatagcgtgctacgtcataactggcacgtcagcagacctcgccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaatagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacattttcagagggagctatttagcaggagctgggcttgctttttctattatgaaatcagttggaacaggaaaaagaggaacaggctcacagggtgaaactttaggagaaaaatggaagaagaagttaaatcaattatcccggaaagagtttgacctttacaagaaatctggaatcactgaagtggatagaacagaagccaaagaagggttgaaaagaggagaaataacacatcacgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacggaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccacggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcaaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaactctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggtcccctgcagaccccaggacgaactaataggaagagcaagaatctctcaaggagcgggatggagccttagagaaaccgcatgtctggggaaagcctacgctcaaatgtggagtctcatgtattttcacagaagagatctcagactagcatctaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7528 - RNA, 9873 nt, synthetic construct
  misc_feature 1..9873: note = derived and/or modified CDS sequence (wt) from DENV-3__FJ024466__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggtatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggagctcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcgaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattctcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacagattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaagcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatcccttatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagacaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacttttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgatcttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacccagccctccagagacacagaaggcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatttcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagtattaaagccggaaatgacatagcaaactgcttgcggaaaaacgggaaaaaggtcattcaacttagcaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagcgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggaacataattcaacatggcactatgatgacgaaaacccctacaaaacctgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacatcaaatggaccctgaacacaggcagctagcgaacgctatatttaagctcacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7529 - RNA, 9873 nt, synthetic construct
  misc_feature 1..9873: note = derived and/or modified CDS sequence (wt) from DENV-3__FJ024467__SS-prME
  source 1..9873: mol_type = other RNA
acatcgctctgtctcatgatggtattgccagcagcacttgctttccatttgacttcacgagatggagagccgcgcatgattgtggggaagaatgaaagaggaaaatccctactttttaagacagcctctggaattaacatgtgcacactcatagccatggacttgggagagatgtgtgatgacacggtcacttataaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggattagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaataagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaattccaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatctctcatagaggtgaaaacctgcacatggccaaaatcacataccctttggagtaacggtgtgctagagagtgacatgatcatcccaaagagtctagctggtcctatttcgcaacacaaccacaggcccgggtaccaaacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagagatgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggtgttacctacctagctttaattgcagcatttaaaatccagccattcttggctttgggatttttcctaagaaaactgacatccagagaaaatttattgttaggagttggactggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcgcaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttccccagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgttggacaacattaacacaccagaagggatcataccagctctctttgagccagaaagggagaagtccgccgccatagacggtgagtaccgcttgaaaggtgagtctaggaagactttcgtggaactcatgaggaggggtgaccttccagtctggttagcccataaagtagcatcagaagggatcaaatacacagatagaaaatggtgctttgatggacaacgtaataatcaaattttagaggagaacatggatgtggaaatctggacaaaggaaggagaaaagaaaaaattgagacccaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggtggtagggcttacaggcatgcggtggaggaactaccagagacaatggaaacacttctactcttgggactcatgatcttgttgacaggtggagcaatgcttttcttaatatcaggtaaagggattggaaagacctcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatactcacattggctgcaataatagcagccaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtactgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggccatggggatcacagcggagtggctctggagaaccttgggaaggaacaaaaaacccaggttatgcacaagggaagagtttacaaaaaaggtcagaactaacgcagccatgggcgccgttttcacagaggagaaccaatgggatagcgcgaaagctgctgttgaggatgagaatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaagattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7530 - RNA, 9873 nt, synthetic construct
  misc_feature 1..9873: note = derived and/or modified CDS sequence (wt) from DENV-3__FJ024468__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgattacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccgaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagtcagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7531 - RNA, 9873 nt, synthetic construct
  misc_feature 1..9873: note = derived and/or modified CDS sequence (wt) from DENV-3__FJ024470__SS-prME
  source 1..9873: mol_type = other RNA
acatcgctctgtctcatgatgatattgccagcagcacttgctttccacctgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattactgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaagagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggataaattggaactcaaaggaatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacatatcaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttataacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccatcatctgccagagaagaagattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctaggaaagagagaagaccagtggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7532 - RNA, 9873 nt, synthetic construct
  misc_feature 1..9873: note = derived and/or modified CDS sequence (wt) from DENV-3__FJ024471__SS-prME
  source 1..9873: mol_type = other RNA
acatcgctctgtctcatgatgatattgccagcagcacttgctttccacctgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattactgaagtggaacctgaagacattgactgctggtgcaaccttacatcaacatgggtgacttatggaacgtgcaatcaagctggagagcatagacgcgacaagagatcagtggcgttagctccccatgtcggcatgggactagacacacgcacccaaacttggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaagagcaggaccagaactacgtgtgtaagcatacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcataccgcattgacaggagccacagaaatccaaaactcaggaggcacaagtatttttgcggggcacttaaaatgcagacttaagatggacaaattggaactcaaaggaatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagccgacatggggtgtgttataaactggaaaggcaaagaactcaaatgtggaagtggaatcttcgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcagggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgacgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaagcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttaacacagaatatcagaaaactaaactgaatgattgggacttcgtggtgacaactgacatttcagaaatgggggccaatttcaaagctgatagagtgatcgacccaagaagatgtctcaaaccagtgatcttgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaaccccccaagacaaccaactcgcatatgtcgtgataggcatacttacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacatactatagagaattccacagcaaatgtgtctctggcagctatagccaaccaggcagtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtgcctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttatcacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccatcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtggttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctaggaaagagagaagaccagtggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7533 - RNA, 9873 nt, synthetic construct
  misc_feature 1..9873: note = derived and/or modified CDS sequence (wt) from DENV-3__FJ182005__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaataggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcggaaacgcagcatgggacaatactcatcaaggtcgagtacaaaggggaagatgtaccttgcaaggttcctttctccacagaggatggacaagggaaagctcacagtggcagactgattacagccaacccagtggtgactaagaaggaggagcctgttaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggaattctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatattaaattaacggtagttgtgggcgacataattggggtcttagagcaaggaaaaagaacactaacaccacaacccatggaactaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattggatccaacgcatctgacaggatgggaatgggcgtcacctacctagctttaattgcaacatttaaaatccagccattcttggctttgggattttttctaagaaaactgacatccagagaaaatttattattaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctactcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtagggcctacaggcatgcggtggaggaactaccagagacaatggaaacacttctactcctaggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttataagaaatctggaattactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgagcgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7534 - RNA, 9873 nt, synthetic construct
  misc_feature 1..9873: note = derived and/or modified CDS sequence (wt) from DENV-3__FJ373302__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcgtggaggcaagtcgagaaggtagagacatgggcccttaggcacccagggttcaccatactagccctatttcttgcccattacataggcacttccttgacccagaaggtggttatatttatactactaatgctggtcaccccatccatgacaatgagatgtgtgggagtgggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggcgtatacccaactatgtgaccataggctaatgtcggcagccgtcaaggatgagagggccgtacatgccgacatgggctattggatagaaagccaaaagaaaggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacaacaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaactcagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaacgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcaaagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacagattcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagttcctggactacatgccttcaatgaagagatttaggaaggaggaggagtcggagggagccatttggtaa

SEQ ID NO: 7535 - RNA, 9873 nt, synthetic construct
  misc_feature 1..9873: note = derived and/or modified CDS sequence (wt) from DENV-3__FJ182007__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcactcaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagcaacatagtaattggaactggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttaacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaagactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccattagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggtatttttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggccatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgctaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaacttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccacaaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatagccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattaggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaggaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacctggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7536 - RNA, 9873 nt, synthetic construct
  misc_feature 1..9873: note = derived and/or modified CDS sequence (wt) from DENV-3__FJ182008__SS-prME
  source 1..9873: mol_type = other RNA
acatcgctctgtatcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaaccaagccggagagcacagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtacatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcctgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaataatatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaaggactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgcttgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtatggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7537 - RNA, 9873 nt, synthetic construct
  misc_feature 1..9873: note = derived and/or modified CDS sequence (wt) from DENV-3__FJ182010__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaagtagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacatcgaacaaatggcaaatggaatcgctctggggctcatggctcttaaactgataacacaatttgaaacataccaattatggacagcattaatctccttaacgtgttcaaacacaatctttacgctgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcaacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtaggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttggcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccagattatgcacaagggaagagtttacaaaaaaggtcagaactaacgcagccatgggagccgttttcacagaggagaaccaatgggacagcgcgaaggctgctgttgaggatgaggacttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggatttttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcggacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7538 - RNA, 9873 nt, synthetic construct
  misc_feature 1..9873: note = derived and/or modified CDS sequence (wt) from DENV-3__FJ182011__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttatttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggagctcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcgaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattctcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaagcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagacaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacttttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatttcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagtattaaagccggaaatgacatagcaaactgcttgcggaagaacgggaaaaaggtcattcaacttagcaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagcgccgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcacacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggaacataattcaacatggcactatgatgacgaaaacccctacaaaacctgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacatcaaatggaccctgaacacaggcagctagcgaacgctatatttaagctcacataccaaaataaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7539 - RNA, 9873 nt, synthetic construct
  misc_feature 1..9873: note = derived and/or modified CDS sequence (wt) from DENV-3__FJ182038__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcattagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagttatgcattgaggggaaaattaccaacataacaactgactcaagatgtcctacccaaggggaagcggttttgcctgaggagcaggaccagaactacgtgtgtaagcacacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaaccctcgggctagaatgctcaccacggacaggtttggatttcaatgaaatgatcttgctaacgatgaagaacaaagcatggatggtgcatagacaatggttttttgacctacctctgccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgctgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacaaccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaatgaggtccatacctggacagagcaatacaaattccaagcagactcaccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggtgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtgcatgccgacatgggctactggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaagatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaacggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaacggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagagggggtctataggatcaaacagcaaggaatttttgggaaaacccaagtaggggttggagtacagaaagaaggagtcttccacaccatgtggcacgttacaagaggggcggtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctatgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgcctgctgtcaccagttagggttccaaattataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccggaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtagtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcatgggccaacctctcaataatgatgaagaccacgctcactggacagaagcaaaaatgctgctggacaacattaatacaccagaagggatcataccagctctctttgagccagaaagggagaagtcagccgccatagacggtgagtatcgcttgaaaggtgaatctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaactccccaagacaaccaactcgcatatgtcgtgataggcatactcacattggctgcaacaatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcaaaaaaggacagctgctggaataatgaagaatccaacggtggatgggataatgacaatagacctagatcccgtaatatatgattcaaaatttgaaaaacaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcgaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggctatgcacaagggaagagtttacaaaaaaggtcagaaccaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7540 - RNA, 9873 nt, synthetic construct
  misc_feature 1..9873: note = derived and/or modified CDS sequence (wt) from DENV-3__FJ182041__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttggctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggattttaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaaaaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgtcgcctggagaacagccaccctgattttggccggagtttcgcttttaccagtgtgccagtcttcgagcatgaggaaatcagactggcttccaatgacagtggcagctatgggagttccaccgttaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacactgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgtcacaagaggggcagtgttaacatataatgggaaaagactggaaccaaactgggctagcgtgaaaaaagatctgatttcatacggaggaggatggagattgagcgcgcaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccggttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccaaagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgcccactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagttatttagatgtggatttgcacccagcatcagcctggacattgtatgctgtggccaccacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggcacacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtttctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgcgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagcctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaaaagatttaggaaggaggaggagtcggagggagccatttggtaa

SEQ ID NO: 7541 - RNA, 9873 nt, synthetic construct
  misc_feature 1..9873: note = derived and/or modified CDS sequence (wt) from DENV-3__FJ390371__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaaccttacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgaccaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagccatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattattaatagtatcaggaatctttccatactccatccccgcgacattgttggtctggcacacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatacaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgacgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttggcccataaagtagcatcagaagggatcaaatatacagatagaaaatggtgctttgatggacaacgtaataatcaaattttagaagagaacatggatgtggagatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgccttcacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggggcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaggctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccagaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgacaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtagttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7542 - RNA, 9873 nt, synthetic construct
  misc_feature 1..9873: note = derived and/or modified CDS sequence (wt) from DENV-3__FJ390372__SS-prME
  source 1..9873: mol_type = other RNA
acatcgctctgtctcatgatggtattgccagcagcacttgctttccatttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacctatggaacgtgcaatcaagccggagagcatagacgcgacaagagatcagtggcgttagctccccatgtcggcatgggattagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaattccaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagactcaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggagtcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatctctcatagaggtgaaaacctgcacatggccaaaatcacataccctttggagtaacggtgtgctagagagtgacatgatcatcccaaagagtctagctggtcctatttcgcaacacaaccacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggtgttacctacctagctttaattgcaacatttaaaatccagccattcttggctttgggatttttcctaagaaaactgacatccagagaaaatttattgttaggagttggactggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcgcaatggcaaaagggggaggaggtgcaggttattgccgtagagcctgggaagaacccaaagaactttcaaaccatgccaggcactttccagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtctaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttccccagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagacagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgttggacaacattaatacaccagaagggatcataccagctctctttgagccagaaagggagaagtccgccgccatagacggtgagtaccgcttgaaaggtgagtctaggaagactttcgtggaactcatgaggaggggtgaccttccagtctggttagcccataaagtagcatcagaagggatcaaatacacagatagaaaatggtgctttgatggacaacgtaataatcaaattttagaggagaacatggatgtggaaatctggacaaaggaaggagaaaagaaaaaattgagacccaggtggcttgatgcccgcacttattcagatcccttagcactcaaggaattcaaggactttgcggctggcagaaagtcaatcgcccttgatcttgtgacagaaataggaagagtgccttcacatctagcccatagaacgagaaacgctctggacaatctggtgatgctgcatacgtcagaacatggtggtagggcttacaggcatgcggtggaggaactaccagagacaatggaaacacttctactcttgggactcatgatcttgttgacaggtggagcaatgcttttcttaatatcaggtaaagggattggaaagacctcaataggactcatttgtgtaattgcttccagcggcatgttgtggatggccgaaatcccactccagtggatcgcgtcggctatagtcctggagttttttatgatggtgttgcttataccagaaccagaaaagcagagaaccccccaagacaaccaactcgcatatgtcgtgataggcatactcacattggctgcaataatagcagccaatgaaatgggattgttggaaactacaaagagagatttaggaatgtctaaggagccaggtgtcgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctataatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtaccgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaatcaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaatatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccaccagagagtctttaaagagaaagtggacaccaggacacccaggtccatgccaggaccaagaagggccatggggatcacagcggagtggctctggagaaccttgggaaggaacaaaaaacccaggttatgcacaagggaagagtttacaaaaaagggcagaactaacgcagccatgggcgccgttttcacagaggagaaccaatgggatagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgccacagctggttgggacacaagaataacagaagatgacctgcacaatgaggaaaagatcacacagcaaatggaccctgaccacaggcagttagcgaccgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7543 - RNA, 9873 nt, synthetic construct
  misc_feature 1..9873: note = derived and/or modified CDS sequence (wt) from DENV-3__FJ205870__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggtgcttgggagaatggagtgtgtggaattaggtcaacgaccagaatggagaatctcctgtggaagcaaatagccaatgaactgaactacatattgtgggaaaacaatatcaaattaacggtagttgtgggcgatataattgggatcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaattacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgattttaccagtgtgccagtcttcgagcatgaggaaatcagactggcttccaatgacagtggcagctatgggagttccacctctaccactttttatttttagcttgaaagacacactcaaaagaagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagtcagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttagaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagctactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcccaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7544 - RNA, 9873 nt, synthetic construct
  misc_feature 1..9873: note = derived and/or modified CDS sequence (wt) from DENV-3__FJ390373__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacaccccaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacgagggaaagctcacaatggcagactgattacagccaacccagtggtgactaagaaggaggagcctgtcaatattgaagctgaacctccttttggggaaagtaatatagtaattggaattggagacaatgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtagtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgactgtggcagctatgggagttccacctctaccactttttatttttagcttgaaagacacactcaaaaggagaagctggccactgaatgaaggggtgatggctgttgggcttgtgagcatcctggccagttctctccttagaaatgatgtacccatggcaggaccattagtggccgggggcttgctgatagcgtgctacgtcataactggcacctcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttctgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgtcacaagaggggcagtgttgacatataatgggaaaagactggaaccaaactgggctagcgtgaaaaaagatctgatctcatacggaggaggatggagattgagcgcacaatggcaaaagggggaggaggtgcaggttattgccgtagagcctgggaagaacccaaagaactttcaaaccatgccaggcacctttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaggagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgcccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaagatggatttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactccaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagcagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccgtggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7545 - RNA, 9873 nt, synthetic construct
  misc_feature 1..9873: note = derived and/or modified CDS sequence (wt) from DENV-3__FJ205871__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggcgtatacccaactatgtgaccataggctaatgtcggcagccgtcaaggatgagagggccgtacatgctgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggttcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7546 - RNA, 9873 nt, synthetic construct
  misc_feature 1..9873: note = derived and/or modified CDS sequence (wt) from DENV-3__FJ390375__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcagtgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagcatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggatatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7547 - RNA, 9873 nt, synthetic construct
  misc_feature 1..9873: note = derived and/or modified CDS sequence (wt) from DENV-3__FJ390376__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcttcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagagagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataatatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaagatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7548 - RNA, 9873 nt, synthetic construct
  misc_feature 1..9873: note = derived and/or modified CDS sequence (wt) from DENV-3__FJ390377__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacatggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatctctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcaaactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatctgcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttattgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaagatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgccatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacagattcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7549 - RNA, 9873 nt, synthetic construct
  misc_feature 1..9873: note = derived and/or modified CDS sequence (wt) from DENV-3__FJ547069__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaacttaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttactgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccaccagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7550 - RNA, 9873 nt, synthetic construct
  misc_feature 1..9873: note = derived and/or modified CDS sequence (wt) from DENV-3__FJ562107__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7551 - RNA, 9873 nt, synthetic construct
  misc_feature 1..9873: note = derived and/or modified CDS sequence (wt) from DENV-3__FJ547071__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgctagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgctggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacagtggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatggcacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagttagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagatggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggagttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacggcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaaacagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagtgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccattttacggacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaagggtggccaatatcaaaaatggacttgggagtacccctgctggcattgggatgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctgattttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacaccatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatatacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttatatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgaattcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacttgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7552 - RNA, 9873 nt, synthetic construct
  misc_feature 1..9873: note = derived and/or modified CDS sequence (wt) from DENV-3__FJ410176__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggctcatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttctcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7553 - RNA, 9873 nt, synthetic construct
  misc_feature 1..9873: note = derived and/or modified CDS sequence (wt) from DENV-3__FJ410177__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaggagggccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgttagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7554 - RNA, 9873 nt, synthetic construct
  misc_feature 1..9873: note = derived and/or modified CDS sequence (wt) from DENV-3__FJ547072__SS-prME
  source 1..9873: mol_type = other RNA
acatcgctctgtctcatgatgatactgccagcagcacttgctttccacttgacttcacgagatggagagccgcgcatgattgtggggaagaatgaaagaggaagatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttgggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7555 - RNA, 9873 nt, synthetic construct
  misc_feature 1..9873: note = derived and/or modified CDS sequence (wt) from DENV-3__FJ547073__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctaaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggttattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagccacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagactttcgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccggagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgaatatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggtatgcggtggaggaactaccagagacaatggaaacactcctactcctgggactcatgatcttgttgacaggtggagcaatgctcttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtgtctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacatgggcttaccacggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggatagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7556 - RNA, 9873 nt, synthetic construct
  misc_feature 1..9873: note = derived and/or modified CDS sequence (wt) from DENV-3__FJ547074__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtttagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgtcagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatccttacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggaaagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacatacagaagacccaccattgagaaagatgtggttttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatttagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7557 - RNA, 9873 nt, synthetic construct
  misc_feature 1..9873: note = derived and/or modified CDS sequence (wt) from DENV-3__FJ547075__SS-prME
  source 1..9873: mol_type = other RNA
acatcgctttgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaattctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgtcagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaatcagatggaccgacaccagaattggaagaagagatgttcaaaaagcgaaatctaaccataatggatcttcatcctgggtcaggaaagacacggaaataccttccagccattgttagagaggcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcagccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatttagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7558 - RNA, 9873 nt, synthetic construct
  misc_feature 1..9873: note = derived and/or modified CDS sequence (wt) from DENV-3__FJ547076__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagctacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgctttgaaaatcaactggtacaagaagggaagctccattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcatcgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtttgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccgtcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgatagcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattgatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactctttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaagaaagatctgatttcatacggaggaggatggagattgagcgcacaatggcaaaagggggaggaggtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggattatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtctccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccggagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattaatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7559 - RNA, 9873 nt, synthetic construct
  misc_feature 1..9873: note = derived and/or modified CDS sequence (wt) from DENV-3__FJ547077__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttattttcatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccattttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgatcttggccggagtttcgcttttaccagtgtgccagtcttcgagcatgaggaaaacagactggcttccaatgacagtggcagctatgggagttccacctctaccacttttcatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagtggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatactactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcatgaaatgtattggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagccttagagaaaccgcatgtctggggaaagcctacgctcaaatgtggaatctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7560 - RNA, 9873 nt, synthetic construct
  misc_feature 1..9873: note = derived and/or modified CDS sequence (wt) from DENV-3__FJ547078__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccactacataggcacttccttgacccagaaggtggttatttttatactactaatgctggtcaccccatccatgacaatgagatgtgtgggagtaggaaacagagattttgtggaaggcctatcaggagccacgtggattgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcattatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacatgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaatataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggccgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgccagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgatatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggacttatttgtgtaattgcttccagcggcatgttgtggatggccgaaattccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagccatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccttttggccagcagagagtctttaaagagaaagtggacaccaggacacccaagtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7561 - RNA, 9873 nt, synthetic construct
  misc_feature 1..9873: note = derived and/or modified CDS sequence (wt) from DENV-3__FJ547079__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgctaaatttcaatgcctggaaccaatagagggaaaagtggtgcaatatgagaacctcaaatacaccgtcatcatcacagtgcacacaggagaccaacaccaggtgggaaatgaaacacagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgtcataaactggaaaggcaaagaactcaaatgtggaagtggaatcttcgtcaccaacgaggtccatacctggacagagcaatacaaattccaagcagactccccaaaaagattggcgacagccatcgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagttagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcttaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttggacttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatattctaacagtgcttttgaaaacagcattactaatagtatcaggaatctttccatactccatacccgcaacattgttggtctggcatacttggcataagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaaccctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccggtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaatcttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtaaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagttcggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggtagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtagagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgagttgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagggcaacctgggcccagaacatacccacagcaattcaacaggtgagaagccttataggcaatgaagagtttctggactacatgccctcaatgaagagatttaggaaggaggaggagtcggagggagccatttggtaa

SEQ ID NO: 7562 - RNA, 9873 nt, synthetic construct
  misc_feature 1..9873: note = derived and/or modified CDS sequence (wt) from DENV-3__FJ547080__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatactgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaagcaatcaagagacgtttaagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacgaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaaggcataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7563 - RNA, 9873 nt, synthetic construct
  misc_feature 1..9873: note = derived and/or modified CDS sequence (wt) from DENV-3__FJ547081__SS-prME
  source 1..9873: mol_type = other RNA
acatcgctctgtctcatgatgatattgccagcagcacttgctttccacttgacttcacgagatggagagccgcgcatgatcgtggggaagaatgaaagaggaaaatccctactttttaagacagcctctggaatcaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggtcttgcctgaggagcaggaccagaactacgtgtgtaagcatacatacgtagacagaggctgggggaacgggtgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtcctcggatcgcaagagggagcaatgcataccgcattgacaggagccacagaaatccaaaactcaggaggcacaagcattttttcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatgggccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatgactcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatgcagatagaaaatggtgctttgatggacaacgtaataatcaaattttagaggagaacatggatgtggaaatctggacaaaggaaggagaaaagaaaaaattgagacctagatggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttcttcaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggacttttggaaacttgtggacagagaacgtgaactccacaaattgggcaagtgtggaagctgtgtatacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatagtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggatgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtgccagtccactgggtccccacaagtagaacgacatggtctattcatgctcaccatcagtggatgaccacagaagacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggaatcggagggagccatttggtaa

SEQ ID NO: 7564 - RNA, 9873 nt, synthetic construct
  misc_feature 1..9873: note = derived and/or modified CDS sequence (wt) from DENV-3__FJ547082__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaatgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgcttttaccagtgtgccagtcttcgagcatgaggaaatcagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgcccactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccacaaagtagcatcagaagggatcaaatatacagatagaaaatggtgctttgatggacaacgtaacaatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtaacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatactactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacgggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7565 - RNA, 9873 nt, synthetic construct
  misc_feature 1..9873: note = derived and/or modified CDS sequence (wt) from DENV-3__FJ547083__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcgtagacgcgacaagagatcagtggcgttagctccccatgtcggcatgggactagacacacgcacccaaacctggatgtcggctgaaggagcttggaggcaagtcgagaaggtagagacatgggcccttaggcacccagggtttaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagacagaggccacccaattggcgaccctaaggaagctatgcattgaggggaaaattaccaacataacaactgactcaagatgtcctacccaaggggaagcggttttgcctgaggagcaggaccagagctacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcgataggaatcattacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaactttacaatgggtgtcttgtgtttggcaatcctctttgaagaggtgatgagaggaaaatttgggaagaaacacatgattgcgggggttttcttcacgtttgtgctccttctctcagggcaaataacatggagagacatggcacacacactaataatgattgggtccagcgcatctgacaggatgggaatgggcgttacctacctagctttaattgcaacatttaaaatccagccattcttggctctgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtagttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactaaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaacgatgaagaccatgctcactggacagaagcaaaaatgctgctggacaacattaatacaccagaagggatcataccagctctctttgagccagaaagggagaagtcagccgccatagacggtgagtatcgcttgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcacacgtcagaacatggcggtagggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtaaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacaaggtgaaaccttaggagaaaaatggaaaaagaaattgaatcaattatcccggaaagagtttgacctttacaagaaatctggaatcactgaagtggatagaacagaagccaaagaagggttgaaaagaggagaaataacacatcatgccgtgtccagaggtagcgcgaaacttcaatggtttgtggagagaaacatggtcattcccgaaggaagagtcatagacttgggctgtggaagaggaggctggtcatattactgtgcaggactaaaaaaagtcacagaagtgcgaggatacacaaaaggcggtccaggacacgaagaaccagtacccatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacacacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgtcaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggttaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgctcactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7566 - RNA, 9873 nt, synthetic construct
  misc_feature 1..9873: note = derived and/or modified CDS sequence (wt) from DENV-3__FJ547084__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagaacttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacaccccaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcccttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaggggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaattgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacatactctttggagtaatggtgtgttagagagtgacatgatcattccaaagagtctagctggccctatctcgcaacacaactacaggcccgggtaccacacccagacggcgggaccctggcatttaggaaaattagagctggacttcaactattgtgaaggaacaacagtagtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgtgggggttttcttcacgtttgtactccttctctcagggcaaataacatggagagatatggcgcacacactaataatgatcgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgacaacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacctcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggaggttgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatttaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctactggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacaagaaacgctctggacaatctggtgatgctgcatacgtcagaacatggcggtaaggcctacaggcatgcggtggaggaactaccagagacaatggaaactctcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaagatggatttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggtcatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgctgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatccagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacataggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgtgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctagggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccgtggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7567 - RNA, 9873 nt, synthetic construct
  misc_feature 1..9873: note = derived and/or modified CDS sequence (wt) from DENV-3__FJ478456__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttaggagagatgtgtgatgacacggtcacttacaaatgcccccacattgccgaagtggaacctgaagacattgactgctggtgcaacctcacatcaacatgggtgacttatggaacgtgcaatcaagccggagagcacagacgcgacaagagatcagtggcgttagctccccatgtcggcatgggactggacacacgcacccaaacctggatgtcagctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggcggaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcaacagccattgcaggtgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaattacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacaatctttacgttgactgttgcctggagaacagccaccctgattttggccggagtttcgattttaccagtgtgccagtcttcgagcatgaggaaatcagactggcttccaatgacagtggcagctatgggagttccacctctaccactttttatttttagcttgaaagacacactcaaaagaagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatccccgcaacattgttggtctggcatacttggcaaaagcaaacccgaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttaacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccgataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggaaaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttagaaactacaaagagagatttaggaatgtctaaggagccaggtgttgtttctccaaccagttatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagctactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagctagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttatcggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7568 - RNA, 9873 nt, synthetic construct
  misc_feature 1..9873: note = derived and/or modified CDS sequence (wt) from DENV-3__FJ547085__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcaataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattgacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaatacaccggagtgtccaaatacctcaagagcatggaatgtgtgggaggtggaagattacgggttcggagtcttcacaaccaacatatggctgaaactccgagaggtgtatacccaactatgtgaccataggctaatgtcggcagccgtcaaggatgaaagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggctggagtttcacttttaccagtgtgtcagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattggtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataactgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcagaaagtcaatagcccttgatcttgtgacagaaataggaagagtgcctacacacctagctcatagaacgagaaacgccctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttgagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattacgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtactgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtttggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaacccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7569 - RNA, 9873 nt, synthetic construct
  misc_feature 1..9873: note = derived and/or modified CDS sequence (wt) from DENV-3__EU482595__SS-prME
  source 1..9873: mol_type = other RNA
acatcgctctgtctcatgatgatgctgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctattccttgcccattacgtaggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgcaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaaggttcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaatactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttctcaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaactagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtctaacgcatctgacaggatgggaatgggcgttacctacctagctttaattgcaacatttaaaatccagccattcttggctttgggatttttcctaagaaaactgacatccagagaaaatttattattaggagttgggctggctatggcaacaacgttacaactgccagaggacattgaacaaatggcaaacggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggattttaagcctggaacttcaggatctcctatcataaacagagagggaaaggtagtgggactgtatggcaatggagtggttacaaagaatggtggctacgtcagcggaatagcgcaaacgaatgcagaaccagatggaccggcaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacagtgtggtttgtccccagcattaaagccggaaatgacatagcaaactgtttgcgaaaaaacgggaaaaaggtcattcaacttagtaggaagacttttgacacagaatatcagaaaactaaactgaatgattgggacttcgtggtgacgactgacatttcagaaatgggggctaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgtctgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacacttctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatactcacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtgatatatgattcaaaatttgaaaagcaactgggacaggttatgctcctggttttgtgtgcagttcaacttttattaatgagaacatcatgggccttgtgtgaagctttaactctagctacaggaccaataacaacactctgggaaggatcacctgggaagttttggaacaccacgatagctgtttccatggcgaacatctttagagggagctatttagcaggagctgggcttgctttttctattatgaaatctgttggaacagggaaaagaggaacaggctcacagggtgaaactttaggagaaaaatggaaaaagaagttaaatcaattatcccggaaagagtttgacctttataagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccttgttgtgtgacattggagaatcttcaccaagcccaacagtggaggaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatgggtatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgagctccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctgggaaaagcctacgctcaaatgtggagtctcatgtattttcacagaagagacctcagactagcatccaacgccatatgttcagcggtaccagtccactgggtccccacaagtagaacgacatggtctattcatgctcaccatcagtggatgaccacagaagacatgcttactgtctggaacagggtgtggatcgaggacaatccatggatggaagataaaactccagtcacaacctgggaaaatgttccatatctagggaagagagaagaccaatggtgcggatcacttattggtcttacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7570 - RNA, 9873 nt, synthetic construct
  misc_feature 1..9873: note = derived and/or modified CDS sequence (wt) from DENV-3__EU482596__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggggtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7571 - RNA, 9873 nt, synthetic construct
  misc_feature 1..9873: note = derived and/or modified CDS sequence (wt) from DENV-3__JQ922554__SS-prME
  source 1..9873: mol_type = other RNA
acatcgctctgtctcatgatgatgttaccagcaacacttgctttccacttaacttcacgagatggagagccgcgcatgattgtggggaagaatgaaagaggaaaatccctactttttaagacagcctctggaatcaacatgtgcacactcatagccatggatttgggagagatgtgtgatgacacggtcacttacaaatgcccccacattaccgaactggagcctgaagacattgactgctggtgcaaccttacatcgacatgggtgacttatggaacatgcaatcaagctggagagcatagacgcgataagagatcagtggcgttagctccccatgtcggcatgggactggacacacgcactcaaacctggatgtcggctgaaggagcttggagacaagtcgagaaggtagagacatgggcccttaggcacccagggtttaccatactagccctatttcttgcccattacataggcacttccttgacccagaaagtggttatttttatactattaatgctggttaccccatccatgacaatgagatgtgtgggagtaggaaacagagattttgtggaaggcctatcgggagctacgtgggttgacgtggtgctcgagcacggtgggtgtgtgactaccatggctaagaacaagcccacgctggacatagagcttcagaagaccgaggccacccaactggcgaccctaaggaagctatgcattgagggaaaaattaccaacataacaaccgactcaagatgtcccacccaaggggaagcgattttacctgaggagcaggaccagaactacgtgtgtaagcatacatacgtggacagaggctggggaaacggttgtggtttgtttggcaagggaagcttggtgacatgcgcgaaatttcaatgtttagaatcaatagagggaaaagtggtgcaacatgagaacctcaaatacaccgtcatcatcacagtgcacacaggagaccaacaccaggtgggaaatgaaacgcagggagttacggctgagataacatcccaggcatcaaccgctgaagccattttacctgaatatggaaccctcgggctagaatgctcaccacggacaggtttggatttcaatgaaatgattttattgacaatgaagaacaaagcatggatggtacatagacaatggttctttgacttacccctaccatggacatcaggagctacaacaaaaacaccaacttggaacaggaaagagcttcttgtgacatttaaaaatgcacatgcaaaaaagcaagaagtggttgtccttggatcacaagagggagcaatgcatacagcactgacaggagctacagagatccaaacctcaggaggcacaagtatttttgcggggcacttaaaatgtagactcaagatggacaaattggaactcaaggggatgagctatgcaatgtgcttgaatacctttgtgttgaagaaagaagtctccgaaacgcagcatgggacaatactcattaaggttgagtacaaaggggaagatgcaccctgcaagattcctttctccacggaggatggacaagggaaagctcacaatggcagactgatcacagccaatccagtggtgaccaagaaggaggagcctgtcaacattgaggctgaacctccttttggggaaagtaatatagtaattggaattggagacaaagccctgaaaatcaactggtacaggaagggaagctcgattgggaagatgttcgaggccactgccagaggtgcaaggcgcatggccatcttgggagacacagcctgggactttggatcagtgggtggtgttttgaattcattagggaaaatggtccaccaaatatttgggagtgcttacacagccctatttagtggagtctcctggataatgaaaattggaataggtgtcctcttaacctggatagggttgaattcaaaaaacacttccatggcattttcatgcattgcgataggaatcattacactctatgtgggagttgtggtgcaagctgacatggggtgtgtcataaactggaaaggcaaagaactcaaatgtggaagtggaattttcgtcactaatgaggtccacacctggacagagcaatacaaatttcaagcagactcccccaaaagactggcaacagccattgcaggcgcttgggagaatggagtgtgcggaattaggtcaacaaccagaatggagaacctcttgtggaagcaaatagccaatgaactgaactacatattatgggaaaacaacattaaattaacggtagttgtaggcgacataactggggtcttagagcaaggggaaagaacactaacaccacaacccatggagctaaaatattcttggaaaacatggggaaaggcaaaaatagtgacagctgaaacacaaaattcctctttcataatagatgggccaagcacaccggagtgtccaagtgcctcaagagcatggaatgtgtgggaggtggaagattacgggttcggagttttcacaaccaacatatggctgaaactccgagaggtgtacacccaactatgtgaccataggctaatgtcggcagccgtcaaggatgagagggccgtacacgccgacatgggctattggatagaaagccaaaagaatggaagttggaagctagaaaaagcatccctcatagaggtgaaaacctgcacatggccaaaatcacacactctttggagcaatggtgtgctagagagtgacatgattatcccaaagagtctagctggtcccatttcgcaacacaaccacaggcccgggtaccacacccaaacggcaggaccctggcacttaggaaaattggagctggacttcaactattgtgaaggaacaacagttgtcatctcagaaaactgtgggacaagaggcccatcattgagaacaacaacagtgtcagggaagttgatacacgaatggtgttgccgctcgtgcacacttcctcccctgcgatacatgggagaagacggctgctggtatggcatggaaatcagacccattaatgagaaagaagagaacatggtaaagtctctagcctcagcagggagtggaaaggtggacaacttcacaatgggtgtcttgtgtttggcaatcctctttgaagaggtgatgagaggaaaatttaggaaaaaacacatgattgcaggggttctcttcacgtttgtgctcctcctctcagggcaaataacatggagagacatggcgcacacactcataatgattgggtccaacgcctctgacagaatggggatgggcgtcacttacctagctctaattgcaacatttaaaattcagccattcttggctttgggattcttcctgaggaaactgacatctagagaaaatttattgctgggagttgggttggccatggcagcaacgttacgactgccagaggacattgaacaaatggcgaatggaattgctttggggctcatggctcttaaactgataacacaatttgaaacataccaactatggacggcattagtttccctaacgtgttcaaatacaattttcacgttgactgttgcctggagaacagccactctgattttagccggaatttcgcttttgccagtgtgccagtcttcgagcatgaggaaaacagattggctcccaatgactgtggcagctatgggagttccacccctaccactttttattttcagtctgaaagatacactcaaaaggagaagctggccactgaatgagggggtgatggcagttggacttgtgagcattctagctagttctctccttaggaatgatgtgcccatggctggaccattagtggctgggggcttgctgatagcgtgctacgtcataactggcacgtcagcagacctcactgtagaaaaagcagcagatgtaacatgggaggaagaggccgagcaaacaggagtgtcccacaatttaatgatcacagttgatgatgatggaacaatgagaataaaagatgacgagactgagaacatcttaacagtgcttttaaaaacagcactactaatagtatcaggcatctttccatactccatacccgcaacactgttggtctggcatacttggcaaaagcaaacccaaagatccggcgtcctatgggacgtacccagccccccagagacacagaaagcggaactggaagaaggggtctataggatcaaacagcaaggaatttttgggaaaacccaagtgggggttggagtacagaaagaaggagttttccacaccatgtggcacgtcacaagaggggcagtgttgacacacaatgggaaaagactggaaccaaactgggctagcgtgaaaaaagatctgatttcatacggaggaggatggagattgagtgcacaatgggcaaaaggaggggagacgcaggttattgccgtagagcctgggaagaacccaaagaactttcaaaccatgccaggcatttttcagacaacaacaggggaaataggagcaattgcactggatttcaagcctggaacttcaggatctcccatcataaacagagagggaaaggtagtgggactgtatggcaatggagtggttacaaagaatggaggctatgtcagtggaatagcgcaaacaaatgcagaactagatggaccgacaccagagttggaagaagagatgttcaaaaagcgaaatctaaccataatggatcttcatcctgggtcaggaaagacgcggaaatatcttccagctattgttagagaggcaatcaagagacgcttaaggactctaattttggcaccaacaagggtagttgcagctgagatggaagaagcattgaaagggctcccaataaggtatcaaacaactgcaacaaaatctgaacacacaggaagagagattgttgatctaatgtgtcacgcaacgttcacaatgcgcttgctgtcaccagtccggggttcaaactacaacttgataataatggatgaggctcatttcacagacccagccagtatagcggctatagggtacatatcaactcgtgtaggaatgggagaggcagccgcaattttcatgacagcaacaccccctggaacagttgatgcctttcctcagagcatccctccaattcaagatgaagagagagacataccggaacgctcatggaattcaggcaatgaatggattactgactttgttgggaagacagtgtggtttgtccctagcatcaaagccggaaatgacatagcaaactgcttgcggaaaaatggaaaaaaggtcattcaactcagcaggaagacctttgacacagaatatcaaaagaccaaactgaatgattgggactttgtggtgacaacagacatttcagaaatgggagccaatttcaaagcagatagagtgatctaccttagaagatgtctcaagccggtgattttgacaaatggacccgagcgggtgatcctggctggaccaatgccagtcaccgtagcgagcgctgcgcaaaggagagggagagttggcaggaacccacaaaaagaaaatgaccagtacatattcatgggccagcctctcaacaatgatgaagaccatgctcactggacagaagcaaaaatgctgctggacaacatcaacacaccagaagggattataccagctctctttgaaccagaaagggagaagtcagccgccatagacggcgaataccgcctgaagggtgagtccaggaagactttcgtggaactcatgaggaggggtgacctcccagtttggctagcccataaagtagcatcagaagggatcaaatatacagatagaaaatggtgctttgatggagaacgtaataatcaaattttagaggagaatatggatgtggaaatctggacaaaggaaggagaaaagaaaaactggagacctaggtggcttgatgcccgcacttattcagatcctttagcactcaaggaattcaaggattttgcagctggcagaaagtcaatcgcccttgatcttgtgacagaaataggaagagtgccttcacacttagcccacacagtacgaaacgccctggacaatttggtgatgctgcacacgtcagaacatggcggtagggcctacaggcatgcagtggaggaactaccagaaacgatggaaacactcttactcctgggactgatgatcttgttaacaggtggagcaatgctcttcttgatatcaggtaaagggattggaaagacttcaataggactcatttgtgtaattgcttccagcggcatgttatggatggctgatgtcccactccaatggatcgcgtcggctatagtcctggagttttttatgatggtgttgctcataccagaaccagaaaagcagagaactccccaagacaaccaactcgcatatgtcgtgataggcatacttacattggctgcaatagtagcggccaatgaaatgggactgttggaaactacaaagagagatttaggaatgtctaaagaaccaggtgttgtttctccaaccagctatttggacgtggacttgcacccagcatcagcctggacattgtacgccgtggccacaccagtaataacaccaatgttgagacacaccatagagaattccacagcaaatgtgtccctggcagccatagctaaccaggcagtggtcctgatgggtttagacaaaggatggccgatatcgaaaatggacttgggcgtaccactattggcactgggttgctattcacaagtgaacccactaactcttgcagcggcagtacttttgctagtcacacattatgcaattataggtccaggattgcaggcaaaagccactcgtgaagctcagaaaaggacagctgctggaataatgaagaatccaacggtggatggaataatgacaatagacctagatcctgtaatatatgattcaaaatttgaaaagcaactaggacaggttatgctcctggttctgtgtgcagttcaacttttgttaatgagaacatcatggcccttgtgtgaagtcctagccctagccacaggaccaataacaacactctgggaaggatcacctgggaagttctggaacaccacgatagctgtttccatggcgaacatctttagagggagctatttagcaggagctgggcttgctttttctatcatgaaatcagttggaacaggaaagagaggaacagggtcacaaggtgaaaccttaggagaaaagtggaaaaagaaattaaatcagttatcccggaaagagtttgacctttacaagaaatccggaatcaccgaagtggatagaacagaagccaaagaagggttaaaaagaggagaaataacacaccatgccgtgtccagaggcagcgcaaaacttcaatggttcgtggagagaaacatggtctttcccgaaggaagagtcatagacttaggctgtggaagaggaggctggtcatattactgtgcaggactgaaaaaagttacagaagtgcgaggatacacaaaaggcggcccaggacacgaagaaccagtacctatgtctacatacggatggaacatagtcaagttaatgagtggaaaggatgttttttatctgccacctgaaaagtgtgataccctattgtgtgacattggagaatcttcaccaagcccaacagtggaagaaagcagaaccataagagtcttgaagatggttgaaccatgggtaaaaaacaaccagttttgcattaaggttttgaacccttacatgccatctgtgattgagcacttggaaaacttacaaaggaaacatggaggaatccttgtgagaaatccactctcacgaaactccacgcacgaaatgtattggatatccaatggtacaggcaacatcgtctcttcagtcaacatggtatccagattgctactgaacagattcacaatgacacacaggagacccaccatagagaaagatgtggatttaggagcaggaacccgacatgtcaatgcggaaccagaaacacccaacatggatgtcattggggaaagaataaaaaggatcaaagaggagcatagttcaacatggcactatgatgatgaaaatccttacaaaacgtgggcttaccatggatcctatgaagtaaaagccacaggctcagcctcctccatgataaatggagtcgtgaaactcctcacaaaaccatgggatgtggtgcccatggtgacacagatggcaatgacagatacaactccatttggccagcaaagagtttttaaagagaaagtggacaccaggacacctaggcccatgccaggaacaagaaaggttatggagatcacagcggagtggctttggaggaccctgggaaggaacaaaagacccagattatgcacaagggaggagttcacaaagaaggtcagaaccaacgcagctatgggcgctgtcttcacagaagagaaccaatgggacagtgcgagagctgctgttgaggacgaagaattttggaaacttgtggacagagaacgtgaactccacaaactgggcaagtgtggaagctgcgtttacaacatgatgggcaagagagagaaaaaacttggagagtttggtaaagcaaaagacagtagggctatatggtacatgtggttgggagccaggtaccttgagttcgaggcgctcggattcctcaatgaagaccactggttctcgcgtgaaaactcttacagtggagtagaaggagaaggactgcacaagctgggatacatcttgagagatatttccaagatacccggaggagccatgtatgctgatgacacagccggttgggacacaagaataacagaagatgacttgcacaatgaggaaaaaatcacacagcagatggcccgtgaacacaggcagctagcgaacgccatattcaagctcacataccaaaacaaagtggtcaaagtccaacgaccaactccaaagggcacggtaatggacatcatatctaggaaagaccaaagaggcagtggacaggtgggaacttatggtctgaacacattcaccaacatggaagcccagctaatcagacaaatggaaggagaaggcgtgttgtcaaaggcagacctcgagaacccccatccgctagagaagaaaattacacaatggttggaaactaaaggagtggagaggttaaaaagaatggccatcagcggggatgattgcgtagtgaaaccaatcgacgacagattcgccaatgccctgcttgccctgaacgatatgggaaaggttaggaaggacatacctcaatggcagccatcaaagggatggcatgattggcaacaggtccctttctgctcccaccactttcatgaattgatcatgaaagatggaagaaagttggtagttccctgcagaccccaggacgaactattagggaaggcgagaatctctcaaggagcaggatggagccttagagaaactgcatgtctagggaaagcctacgctcaaatgtggactctcatgtattttcacagaagagatcttagactagcatccaacgccatatgttcagcagtaccagtccattgggtccccacgagcagaacgacatggtctattcatgctcaccatcagtggatgactacagaagacatgcttactgtctggaacagggtgtggatagaggacaatccatggatggaagacaaaactccagtcacaacgtgggaagatgttccatatctagggaagagagaagaccaatggtgcggatcactcataggtctcacttccagagcaacctgggcccagaacatactcacagcaatccaacaggtgagaagcctcataggcaatgaagagtttctggactacatgccttcgatgaagagattcaggaaggaggaggagtcagagggagccatttggtaa

SEQ ID NO: 7572 - RNA, 9873 nt, synthetic construct
  misc_feature 1..9873: note = derived and/or modified CDS sequence (wt) from DENV-3__EU529683__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggccctcaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggttaatgtcggcagccgtcaaggatgaaagggccgtacatgccgacatgggctattggatagaaagtcaaaagaatggaagttggaagctagaaaaagcatccctcatagaggtgaaaacctgcacatggccaaaatcacataccctttggagtaatggtgtgttagagagtgacatgatcattccaaaaagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagaaaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctctcaaactgataacacaatttgaaacataccaactatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcaggaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacactggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttgagacataccatagagaattccacagcaaatgtgtccttggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaggtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactacgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccataagcggggatgactgcgtagtgaaaccaatcgatgacaggttcgctaatgccctgctcgctctgaacgacatgggaaaggtccggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7573 - RNA, 9873 nt, synthetic construct
  misc_feature 1..9873: note = derived and/or modified CDS sequence (wt) from DENV-3__EU529684__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaaagttggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaattaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaaaaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagaggcgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaccgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactactaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaatatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggatgagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagttcacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatttaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggagatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7574 - RNA, 9873 nt, synthetic construct
  misc_feature 1..9873: note = derived and/or modified CDS sequence (wt) from DENV-3__FJ182015__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcctggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaggaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggcgctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgctatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7575 - RNA, 9873 nt, synthetic construct
  misc_feature 1..9873: note = derived and/or modified CDS sequence (wt) from DENV-3__EU569688__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagcggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagatagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgagggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaagactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcatggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaggtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7576 - RNA, 9873 nt, synthetic construct
  misc_feature 1..9873: note = derived and/or modified CDS sequence (wt) from DENV-3__EU529686__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaatgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtgattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcctggataccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaactatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacggttgatgatgatggaacaatgagaataaaagatgatgagactgagaatatcttaacagtgcttttgaaaacagctttactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaataatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttacttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttgaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggattgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgagaatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaactctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7577 - RNA, 9873 nt, synthetic construct
  misc_feature 1..9873: note = derived and/or modified CDS sequence (wt) from DENV-3__EU529687__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggtatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtggacagaggttgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcatcgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagcaatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgtcggaatgggagaagcagccgcaattttcatgacagcaacgccccctggaacagctgatgcctttcctcagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggataaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagtcttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccagagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7578 - RNA, 9873 nt, synthetic construct
  misc_feature 1..9873: note = derived and/or modified CDS sequence (wt) from DENV-3__KF955449__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttgtactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtacaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcatcctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctacttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactctaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaatgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagatctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7579 - RNA, 9873 nt, synthetic construct
  misc_feature 1..9873: note = derived and/or modified CDS sequence (wt) from DENV-3__FJ373303__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccagacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatgtcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtgacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatttttgggaaaacccaagtaggggttggagtacagaaagaaggagtctttcacaccatgtggcacgttacaagaggggcagtgctgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagctgccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcgaaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttctagcggcatgttgtggatggctgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacctctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccctgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaagtcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacgtagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7580 - RNA, 9873 nt, synthetic construct
  misc_feature 1..9873: note = derived and/or modified CDS sequence (wt) from DENV-3__KF955451__SS-prME
  source 1..9873: mol_type = other RNA
acatcgctctgtcttatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaagtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaacacttttgtgttgaagaaagaagtctcagaaacgcagcatgggacaatactcatcaaggtcgagtacaaaggggaagatgtaccttgcaagattcctttctccacagaggatggacaagggaaagctcacaatggcagactgatcacagccaacccagtggtgactaagaaggaggagcctgtcaatattgaggctgaacctccttttggggaaagtaatatagtaattggagttggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagttgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcaacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagatggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagtcgggctggctatggcaacaacgttacaactgccagaggacgttgaacaaatggcaaatggaatcgctctggggctcatggctcttaaactgataacacaatttgaaacataccaattatggacagcattaatctccttaacgtgttcaaatacaatttttacgctgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctatgtcataactggcacgtcagcagacctcaccgtagaaaaagcagcagatgtaacatgggaggaagaggctgagcaaacaggagtgtcccacaatttaatgatcacagttgatgatgatggaacaatgagaataaaagatgatgagactgaaaacatcttaacagtgcttttgaaaacagcattactaatagtatcaggaatctttccatactccatacccgcaacattgttggtctggcatacttggcaaaagcaaacccaaagatccggcgttttatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatacaatgggaaaagactggaaccaaactgggctagcgtgaaaaaagatctgatttcatacggaggaggatggagattgaacgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggatacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaagcgctctggacaatctggtgatgctgcatacgtcagaacatggcggtaaggcctacaggcatgcggtggaggaactaccagagacaatggaaacactcctactcttgggactcatgatcttgctgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatactcacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcactgggttgctattcacaagtgaacccattgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaactcttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaggaagttaaatcaattatcccggaaagagtttgacctttacaagaaatctggaatcactgaagtggatagaacagaagccaaagaagggttgaaaagaggagaaataacacatcatgccgtatccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacacacagaagacccaccattgagaaagatgtggatttaggagcaggaactcgacatgtcaacgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaagccatgggatgtggtgcccatggtgacacagatggcaatgacagatacaactccatttggccagcagagagtctttaaagagaaagtggacaccaggacacccaggcccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttctggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaacccccatctgtcagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagattcaggaaggaggaggagtcggagggagccatttggtaa

SEQ ID NO: 7581 - RNA, 9873 nt, synthetic construct
  misc_feature 1..9873: note = derived and/or modified CDS sequence (wt) from DENV-3__KF955453__SS-prME
  source 1..9873: mol_type = other RNA
acatcgctctgtctcatgatgatattgccagcaacacttgctttccacttgacttcacgagatggagagccgcgcatgattgtggggaagaatgaaagagggaaatccctactctttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaatataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaattccaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccaccttgcctgaatatggaacccttgggctagaatgctcaccacggacaggtttggactttaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcagggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctatcgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagccatgggagttccacctctaccactttttatttttaacttaaaagacacacttaaaaggagaagctggccactgaatgaaggggtgatggctgttgggcttgtgagcattctggctagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaagtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacatacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctggaaaaacggtgtggtttgtccccagcattaaagccggaaatgacatagcaaactgcctgcggaaaaacggaaaaaaggtcattcaactcagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgagtgatcctggctggaccaatgccagtcaccgcggcgagtgctgcgcaaaggagagggagagttggcaggaacccacaaaaagaaaatgaccagtacatattcacgggccagcctcttaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatctcgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacactgtacgctgtggccactacagtaataacaccaatgttaagacataccatagagaattctacagcaaatgtgtccctggcagctatagccaaccaggcagtggtcctgatgggtttggacaaagggtggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaagaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaaccagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggtgccatttggtaa

SEQ ID NO: 7582 - RNA, 9873 nt, synthetic construct
  misc_feature 1..9873: note = derived and/or modified CDS sequence (wt) from DENV-3__FJ373304__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaactcttgggctagaatgctcaccacggacaggtttggacttcaatgaaatgatcttgttaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacaccgcattgacaggagccacagaaatccaaaactcaggaggcacaagcatttttgcggggcacttaaaatgtagacttaagatggacaaattagaactcaagggaatgagctatgcaatgtgcacgaacacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaagtggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaggcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgctaggagttgggctggctatggcaacaacgttacaactgccagaggacattgaacaaatggcaaatggaatcgctctggggctcatggctctcaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttattttcagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacaaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgacctaatgtgccacgcaacgttcacaatgcgtctgctgtcaccagttagggttccaaattataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaggaaagggacataccagaacgctcatggaattcaggcaatgaatggataaccgacttcgctgggaaaacggtgtggtttgttcccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcacagcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacttagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccataatcctggagttttttatgatggtgttgcttataccagaaccagaaaagcagagaaccccccaagacaaccaactcgcatatgtcgtgataggcatacttacattggcggcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatctcctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaagcttcaatggtttgtggagagaaacatggtcattcccgaaggaagagttatagacttgggctgtggaagaggaggttggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagagacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccatcagcggggatgattgcgtagtgaaaccaatcgatgacaggttcgctaatgccctgctcgccctgaacgatatgggaaaggttcggaaggacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7583 - RNA, 9873 nt, synthetic construct
  misc_feature 1..9873: note = derived and/or modified CDS sequence (wt) from DENV-3__EU854291__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacgatcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccacaggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccgtcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgctcaaatacaattttcacgttgactgttgcctggagaacagccaccctgattttggccggagtttcgcttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacctgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggatcagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcattggacggaagcaaaaatgctgctggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcttggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctggatcctgtaatatatgattcaaaatttgaaaagcaactgggacaggttatgctcctggttttgtgtgcagttcagcttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatgggtggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccctacatgccaactgtgattgagcacctagaaagactacaaaggaaacatggaggaatgcttgtgagaaatccactttcacgaaactccacgcacgaaatgtactggatatccaatggcacaggtaatattgtcgcttcagtcaacatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggataccagaacacccaggcccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagagaccgcatgtctggggaaagcctacgctcaaatgtggagtctcatgtactttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7584 - RNA, 9873 nt, synthetic construct
  misc_feature 1..9873: note = derived and/or modified CDS sequence (wt) from DENV-3__KF955454__SS-prME
  source 1..9873: mol_type = other RNA
acatcgctttgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgacaagagatcagtggcgttagctccccatgtcggcatgggattggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggccaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagaaggaaaagtggtgcaatatgagaacctcaaatacaccgtcatcatcacagtgcacacaggagaccaacaccaggtgggaaatgaaacacagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttctcgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactatatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagggtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacatttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggccatggcaacaacgttacaactgccagaggacattgaacaaatggcaaatggaatcgctctggggctcatggctcttaaactgataacacaatttgaaacataccaattatggacagcattaatctccttaacgtgttcaaacacaatttttacgttgactgttgcctggagaacagctaccctgattttggccggagtttcgcttttaccagtgtgccagtcttcgagcatgaggaaaacagactggcttccaatgacggtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttgacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgttgagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggtagcagctgagatggaggaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcgaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcctggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccagctcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttgggagaaaaatggaaaaagaaattaaatcaattatcccggaaagagtttgacctttacaagaaatctggaatcactgaagtggatagagcagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgatattggagaatcttcaccaagcccaacagtggaagaaagcagaactataagagttttgaagatggttgaaccatggctaaagaacaaccaattttgtattaaagtactgaacccttacatgccaactgtgattgagcacctagaaagactacaaaggaaacatggaggaatgcttgtgagaaatccactttcacgaaactccacgcatgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaatcaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatccgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagggacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaacgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggaaggagccatttggtaa

SEQ ID NO: 7585 - RNA, 9873 nt, synthetic construct
  misc_feature 1..9873: note = derived and/or modified CDS sequence (wt) from DENV-3__EU854292__SS-prME
  source 1..9873: mol_type = other RNA
acatcgctctgtctcatgatgatattgccagcagcacttgctttccacttgacttcacgagatggagagccgcgcatgattgtgggtaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtggagacatgggcccttaggcacccagggttcaccatactagccctatttcttgcccattacataggcacatccttgacccagaaggtggttatttttatactactaatgctggtcaccccatccatgacgatgagatgtgtgggaataggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaacatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaactcttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaagaaacaagaagtagttgtccttggatcgcaagagggagcaatgcacaccgcattgacaggagccacagaaatccaaaactcaggaggcacaagtatttttgcggggcacttaaaatgcaggcttaagatggacaaattggaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggcgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagaacaatacaagttccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgccgcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggattgaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccttgcgatacatgggagaagacggatgctggtatggcatggaaatcagacccatcagtgagaaagaagagaacatggtaaagtctttagtctcagcgggaagtggaaaggtggacaacttcacaatgggtgtcttgtgcttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctcagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaacacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttattttttgcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggaatctttccatactccatacccgcaacattgctggtctggcatacttggcaaaagcaaacccaaaggtccggcgttctatgggacgtacccagccccccagagacacagaaagcagaactggaagaaggggtctataggatcaaacagcaaggaatttttgggaaaacccaagtgggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaacgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggagaggcagccgcaattttcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatctcagaaatgggggccaacttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacataaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgctatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaatcgcccttgatcttgtgacagaaataggaagagtgccttcacacctagcccatagaacgagaaacgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggctatagtcctggagttttttatgatggtgttgcttataccagaaccagaaaagcagagaaccccccaagacaaccaactcgcatatgtcgtgataggcatacttacattggctgcaataatagcagctaatgaaatgggattgctggaaactacaaagagagatttaggaatgtctaaggagccaggtgttgtctctccaactagctatttagatgtggacttgcacccagcatcagcctggacattgtacgccgtggccactacagtaataacaccaatgttaagacataccatagagaattctacagcaaatgtatctctggcagctatagccaaccaggcagtggtcctgatgggtttggacaaaggatggccaatatcaaaaatggacctaggagtacccctactggcattgggttgctattcacaagtgaacccactaactctaacagcggcagtactcttgctgatcacacattatgctattataggtccaggattgcaagcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttctgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttccattatgaaatcagtaggaacaggaaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcctcagtcaacatggtatctagactgctactgaacaggttcacgatgacacacagaagacccaccattgagaaagatgtggatttaggagcaggaactcgacatgttaatgcggaaccagaaacacccaatatggatgtcattggggaaagaataaaaaggatcaaggaggagcataattcaacatggcactatgatgacgaaaacccctacaaaacgtgggcttatcatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacctaggttatgcacaagggaagagtttacaaagaaggtcaggactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttaggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagcctcaaagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaggacatgcttactgtctggaacagggtgtggatcgaggacaatccatggatggaagacaaaactccagttacaacctgggaaaatgttccatatctagggaagagagaagaccaatggtgcggatcacttattggtctcacttccagagcaacctgggcccagaacatacctacagcaattcaacaggtgagaagccttataggcaatgaagagtttctggactacatgccttcaatgaagagatttaggaaggaggaggagtcggagggagccatttggtaa

SEQ ID NO: 7586 - RNA, 9873 nt, synthetic construct
  misc_feature 1..9873: note = derived and/or modified CDS sequence (wt) from DENV-3__FJ639746__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgatcttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccaatcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7587 - RNA, 9873 nt, synthetic construct
  misc_feature 1..9873: note = derived and/or modified CDS sequence (wt) from DENV-3__FJ639750__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7588 - RNA, 9873 nt, synthetic construct
  misc_feature 1..9873: note = derived and/or modified CDS sequence (wt) from DENV-3__FJ639754__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggagagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctcttcttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggaactatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcctcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggtaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7589 - RNA, 9873 nt, synthetic construct
  misc_feature 1..9873: note = derived and/or modified CDS sequence (wt) from DENV-3__FJ639757__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactattaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtggacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacagcgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcactaacgaggttcatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggtcttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctttaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacgttgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaaaactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcccacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttactgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagagataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7590 - RNA, 9873 nt, synthetic construct
  misc_feature 1..9873: note = derived and/or modified CDS sequence (wt) from DENV-3__FJ639758__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgtctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttctttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggataaattagaactcaaggggatgagctatgcaatgtgcacgaatacctttgtgttgaagaaagaagtctcagaaacacagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatgtaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaacggaagttggaagctagaaaaagcatccctcatagaggtaaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactactgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatttttatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtattgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaactatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccggtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcatgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaggtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaatatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7591 - RNA, 9873 nt, synthetic construct
  misc_feature 1..9873: note = derived and/or modified CDS sequence (wt) from DENV-3__FJ639759__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttctcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggattccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatggaaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctatgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacatcagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataactcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatttgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7592 - RNA, 9873 nt, synthetic construct
  misc_feature 1..9873: note = derived and/or modified CDS sequence (wt) from DENV-3__FJ639761__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggccctcaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctgcaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagaacctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtatcaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggagtaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaaccacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggcttacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgctggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcggcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7593 - RNA, 9873 nt, synthetic construct
  misc_feature 1..9873: note = derived and/or modified CDS sequence (wt) from DENV-3__FJ639762__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacaccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaagatcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcggggattttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaaacaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaagactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7594 - RNA, 9873 nt, synthetic construct
  misc_feature 1..9873: note = derived and/or modified CDS sequence (wt) from DENV-3__FJ639763__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgcagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagaccaatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacaacaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggacgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaagtcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaagcatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagtccaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaacggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7595 - RNA, 9873 nt, synthetic construct
  misc_feature 1..9873: note = derived and/or modified CDS sequence (wt) from DENV-3__FJ639765__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactgatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggcttatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccataatcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtctctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcgaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactttagctacaggaccaataacaacactctgggaaggatcacctgggaagttttggaacaccacgatagctgtttccatggcgaacatttttagagggagctatttagcaggagctgggcttgccttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggacgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagtggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7596 - RNA, 9873 nt, synthetic construct
  misc_feature 1..9873: note = derived and/or modified CDS sequence (wt) from DENV-3__FJ639766__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcattatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggaacctgtcaatattgaggctgaacctccttttggggaaagtaatatagtaattggaattggagacaacgccttgaaaatcaactggtacaagaagggaagctctattgggaagatgttcgaggccactgctagaggtgcaaggcgtatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaatcgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggtcccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7597 - RNA, 9873 nt, synthetic construct
  misc_feature 1..9873: note = derived and/or modified CDS sequence (wt) from DENV-3__FJ639767__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgcggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaagggaaaagaacactaacaccacaacccatggagctaaaatactcatggaaaacgtggggaaaggcaaaaatagtgacagctgaaacacaaaactcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttggaaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcactactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccggctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggtaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaatcagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccgataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgttattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtcacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttaggagccaggtaccttgagttcgaagcccttggattcttaaatgaagaccactggttctcgcgtgagaactcttacagtggagtggaaggagaaggactgcataagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 7598 - RNA, 9873 nt, synthetic construct
  misc_feature 1..9873: note = derived and/or modified CDS sequence (wt) from DENV-3__FJ639768__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtaggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacactgcattgacaggagccacagaaatccaaaactcaggaggtacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggagttctcttgacttggatagggttgaattcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgaacgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaataccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatatagcaggagctgggcttgctttttctattatgaaatcagttggaacaggaaaaagaggaacaggctcacagggtgaaactttaggagaaaaatggaaaaagaagttaaatcaattatctcggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7599 - RNA, 9873 nt, synthetic construct
  misc_feature 1..9873: note = derived and/or modified CDS sequence (wt) from DENV-3__FJ639769__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcctggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggcttatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcgaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagttcaacttttgttaatgagaacatcatgggccttgtgtgaagctttaactttagctacaggaccaataacaacactctgggaaggatcacctgggaagttttggaacaccacgatagctgtttccatggcgaacatttttagagggagctatttagcaggagctgggcttgccttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggacgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7600 - RNA, 9873 nt, synthetic construct
  misc_feature 1..9873: note = derived and/or modified CDS sequence (wt) from DENV-3__FJ882577__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacaccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagactacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcggggattttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaaacaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaagactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgcgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaagaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagcagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7601 - RNA, 9873 nt, synthetic construct
  misc_feature 1..9873: note = derived and/or modified CDS sequence (wt) from DENV-3__FJ850096__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaacattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggacttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgtggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgcccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcactgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccgataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggacttaggagcaggaactcgacatgttaatgcggaaccagaaacacccaacatggatgttattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtcacacagatggcaatgacagatacaactccatttggccaacagagagtctttaaagagaaagtggacaccaggacacccaggtccatgccaggaacaagaagggtcatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcataagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcacgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggggccatttggtaa

SEQ ID NO: 7602 - RNA, 9873 nt, synthetic construct
  misc_feature 1..9873: note = derived and/or modified CDS sequence (wt) from DENV-3__FJ882578__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacgggggatgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagtttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacattcaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaatactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatctagagaaaatttattgctaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagacctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcaaccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7603 - RNA, 9873 nt, synthetic construct
  misc_feature 1..9873: note = derived and/or modified CDS sequence (wt) from DENV-3__FJ639770__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacatcgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctttaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccttattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatgtaattggggtcttagagcaaggaaaaagaacactaacactacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccacttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcatccaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtgcctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7604 - RNA, 9873 nt, synthetic construct
  misc_feature 1..9873: note = derived and/or modified CDS sequence (wt) from DENV-3__FJ639771__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggtcttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacacagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacattttgcgggaaaacaatatcaaattaacggtagttgtgggcgatgtaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaggattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaacggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgcttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatagttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccccggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaacttatgaggaggggtgaccttccagtctggttagcccataaagtagcatcagaagggatcaaatatacagatagaaaatggtgctttgatggacaacgtaataatcaaattttggaagagaacatggatgtggaaatctggacaaaggaaggagaaaagaaaaaattgagacctaggtggcttgatgcccgcacctattcagatcccttagcactcaaggaattcaaagactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcgggctgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggttcttatgaagtcaaagccacaggctcagcctcctccatgataaatggagtcgtgaaactcctcaccaaaccatgggatgtggtgcccatggtgacacagatggcaatgacagatacaactccatttggccagcagagagtatttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtag

SEQ ID NO: 7605 - RNA, 9873 nt, synthetic construct
  misc_feature 1..9873: note = derived and/or modified CDS sequence (wt) from DENV-3__FJ639772__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatttccttaacgtgttcaaatacaatttttacgttgactgttgcctggagaacagccaccctgattttggccggagtttcgcttttaccagtgtgccagtcttcgagcatgaggaaaacagactggattccaatgacagtggcagctatgggagttccacctctaccactttttatttttagcttaaaagacacactcaaaaggagaagttggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttatcgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacatcagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccggtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7606 - RNA, 9873 nt, synthetic construct
  misc_feature 1..9873: note = derived and/or modified CDS sequence (wt) from DENV-3__FJ639774__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggaactacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcactaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgcttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtggagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggtagaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaagcttgtggacagagaacgtgaactccacaaactgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7607 - RNA, 9873 nt, synthetic construct
  misc_feature 1..9873: note = derived and/or modified CDS sequence (wt) from DENV-3__FJ639775__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctacttttcaagacagcctctggaattaacatgtgcacactcatagccatggacttgggagaaatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacgtgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagcggaatcttcgtcaccaacgaggtccatacctggacagagcaatacaaattccaagcagactccccaaaaagattggcgacagctattgcaggcgcttgggagaatggagtgtgcggaattaggtcaacaaccagaatggagaatctcctgtggaagcaaatagccaatgaactgaactacatactgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagctggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccctaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtaccaatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttgacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcataccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaacccgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcacagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgcttctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagagagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggctatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgcctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7608 - RNA, 9873 nt, synthetic construct
  misc_feature 1..9873: note = derived and/or modified CDS sequence (wt) from DENV-3__FJ639777__SS-prME
  source 1..9873: mol_type = other RNA
acatcgctctgtctcatgatgacattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaagcatcaactactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaagagcttcttgtgacatttaaaaacgcacatgcgaaaaaacaagaagtagttgtccttggatcgcaagagggagcaatgcacactgcattgacaggagccacagaaatccaaaactcaggaggtacaagcatttttgcggggcacttaaaatgtagacttaagatggacaaattagaactcaaggggatgagctatgcaatgtgcacgaatacctttgtgttgaaaaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctaggggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtggcagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaacttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggctcgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgaacgcacaatggcaaaagggggaggaggtgcaggttattgccgtagagcccgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcatccaacttagcaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaataccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgttattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatatagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcactcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaagtccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttctggaaacttgtggacagagaacgtgaactccacagattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagatcaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7609 - RNA, 9873 nt, synthetic construct
  misc_feature 1..9873: note = derived and/or modified CDS sequence (wt) from DENV-3__FJ639778__SS-prME
  source 1..9873: mol_type = other RNA
acatcgctctgtctcatgatgatattgccagcagcacttgctttccacttgacttcacgagatggagagccgcgcatgattgtggggaagaatgaaagaggtaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggagaatcaccaacataacaactgactcaagatgtcctacccaaggggaagcggttttgcctgaggagcaggaccagaactacgtgtgtaagcatacatacgtggacagaggctgggggaatggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatggtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgttcgtgcacacttcctcccctgagatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgaccgttgcctggagaacagccaccctgattttggccggagtttcgcttttaccagtgtgccagtcttcgagcatgaggaaaacagactggcttccaatgacagtagcagctatgggagttccacctctaccactttttatttttagcttaaaagacacactcaaaaggagaagctggccactgaatgaaggggtgatggctgttgggcttgtgagcattctggccagttctctccttaaaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggacttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcgaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagaccccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggtttggacaaaggatggccaatatcgaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagccgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgagaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaattaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaaccccatttggccagcagagagtctttaaagagaaagtggacaccaggacacccaggtccatgccaggaacaagaagggttatggggatcacagcggagtggctctggagaaccttgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgactgcgtggtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactgataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacgtggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 7610 - RNA, 9873 nt, synthetic construct
  misc_feature 1..9873: note = derived and/or modified CDS sequence (wt) from DENV-3__FJ639779__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaaaggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatctttgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggactttgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccggcaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctataggcatgcggtggaggaactaccagagacaatggaaacactcctactcttgggactcatgatcttgttgacaggtggagcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaagggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacatcgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcttccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagggaagaccaatggtgtggatcacttattggtctcacttccagagcaacctgggcccagaacatacccacagcaattcaacaggtgagaagccttataggcaatgaagagtttctggactacatgcctgcaatgaagagatttaggaaggaggaggagtcggagggagccatttggtaa

SEQ ID NO: 7611 - RNA, 9873 nt, synthetic construct
  misc_feature 1..9873: note = derived and/or modified CDS sequence (wt) from DENV-3__FJ639780__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaaccttacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggaactacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccattttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggaattccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtggagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggtagaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaagcttgtggacagagaacgtgaactccacaaactgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcggcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7612 - RNA, 9873 nt, synthetic construct
  misc_feature 1..9873: note = derived and/or modified CDS sequence (wt) from DENV-3__FJ639781__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccaatacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacattcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacatatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgcgaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgcactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagaccacaacaggggaaataggagcaattgcactggatttcaagcctggaacctcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactacaacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaattgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgctgcttataccagaaccagaaaagcagagaaccccccaagataaccaactcgcatatgtcgtgataggcatacttacattggcagcaacaatagcagccaacgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccatcagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactggcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7613 - RNA, 9873 nt, synthetic construct
  misc_feature 1..9873: note = derived and/or modified CDS sequence (wt) from DENV-3__FJ639782__SS-prME
  source 1..9873: mol_type = other RNA
acatcgctctgtctcatgatgatattgccagcagcacttgctttccacttgacttcacgagatggagagccgcgcatgattgtggggaagaatgagagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgatgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtttcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggattttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttgatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgacgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtattgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaacggtggctacgtcagcggaatagcgcaaacgaatgcagaaccagatggaccgacaccagaattggaagaagaaatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcttggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaagaacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactctacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 7614 - RNA, 9873 nt, synthetic construct
  misc_feature 1..9873: note = derived and/or modified CDS sequence (wt) from DENV-3__FJ639785__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccacaggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacggaagcaaaaatgctgctggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctggatcctgtaatatatgattcaaaatttgaaaagcaactgggacaggttatgctcctggttttgtgtgcagttcagcttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatgggtggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggataccagaacacccaggtccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtactttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7615 - RNA, 9873 nt, synthetic construct
  misc_feature 1..9873: note = derived and/or modified CDS sequence (wt) from DENV-3__FJ639786__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggatacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtttatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgttcaccacggacaggtttggacttcaatgaaatgatcttgctaacaatgaagaacaaagcatggatggtacatagacaatggttttttgacctacctctaccatgggcatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccaccgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtggttgtgggcgatataattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctaaaactccgagaggtgtatacccaactatgtgaccataggctaatgtcagcagccgtcaaggatgagagggccgtacatgccgacatgggctattggatagaaagccaaaagaatggaagttggaagctagaaaaagcatccctcatagaggtgaaaacctgcacatggccaaaatcacataccctttggagcaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacatcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctattataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagctagtatagctgctagagggtacatatcaactcgtgttggaatgggagaagcagccgcaattttcatgacagcaacaccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatatcagaaatgggggccaatttcaaaacagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaagaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagacttaggaatgtctaaggagccaggtgttgtttctccaaccagctatttagatgtggacttgcacccagcatcagcctggacattgtacgctgtagccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttgggagaaaaatggaaaaagaagttaaatcaattatcccggagagagtttgacctttacaagaaatctggaatcactgaagtggatagaacagaagccaaagaagggttgaaaagaggagaaataacacatcatgccgtgtccagaggtagcgcaaaacttcaatggtttgtggagagaaatatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacggatacaactccatttggccagcagagagtctttaaagagaaagtggacaccaggacacccaggcccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttgggttcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagatctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttattggtctcacttccagagcaacctgggcccagaacatatccacagcaattcaacaggtgagaagccttataggcaatgaagagtttctggactacatgccttcaatgaagagatttaggaaggaggaggagtcggagggagccatttggtaa

SEQ ID NO: 7616 - RNA, 9873 nt, synthetic construct
  misc_feature 1..9873: note = derived and/or modified CDS sequence (wt) from DENV-3__FJ639787__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggttgtcggctgaaggagcttggaggcaagttgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggaaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtctttacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatctttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgctggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccattcggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7617 - RNA, 9873 nt, synthetic construct
  misc_feature 1..9873: note = derived and/or modified CDS sequence (wt) from DENV-3__FJ639790__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagatacctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatctatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggacgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcctcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcccgggaagaacccaaagaactttcaaaccatgccaggcacttttcagactacaacaggggaaataggagcaatcgcactagatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatcgttagagaggcaatcaagagacgtttgagaactctaattctggcaccgacaagggtggttgcagctgagatggaagaagcattgaaaggactcccaataaggtaccaaacaacagcaacgaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctgataccagaaccagaaaagcagagaaccccccaagacaaccaactcgcatatgtcgtgataggcatacttacattggcagcaataatagcagccaatgaaatgggattgttggaaactacaaagagagatttaggaatgtctaaagaaccaggtgttgtttctccaaccagctatttagatgtggacttgcacccagcatcagcctggacattgtacgctgtggctactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagagagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccagcaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcagggagcgggatggagtcttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7618 - RNA, 9873 nt, synthetic construct
  misc_feature 1..9873: note = derived and/or modified CDS sequence (wt) from DENV-3__FJ639791__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccagtagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcctagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaatataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaagatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttagaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgactcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaataagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacacgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtacgctgatgacacagctggttgggacacaagaataacagaagatgacctgcacaacgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7619 - RNA, 9873 nt, synthetic construct
  misc_feature 1..9873: note = derived and/or modified CDS sequence (wt) from DENV-3__FJ639792__SS-prME
  source 1..9873: mol_type = other RNA
acatcgctttgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcttggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttggactagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccctgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacgtggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacggagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagaaagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgacagttgcctggagaacagccaccctgattttggccggagtctcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattttggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggggtctttcacaccatgtggcacgttacaagaggggcagtgttgacacataatgggaaaagactggaaccaaactgggctagcgtgaaaagagatctgatttcatacggaggaggatggagattgagcgcacaatggcaaaagggagaggaggtgcaggttattgccgtagagcctgggaagaacccaaagaactttcaaaccatgccaggcacttttcagactacaacaggggaaataggagcaattgcactggatttcaagcctggaacctcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaggaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcaggaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgctttttttaatatcaggtaaagggattggaaagacttcaataggactcatttgtgttattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagcccagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagaaaaagtggacaccaggacacccaggtccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcataatgaggaaaagatcacacagcaaatggaccctgaacacaggcaattagcgaacgctatatttaagctcacatatcaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctaccagagaagaaaatcacacaatggttggaaaccaaaggagtggagaggttaaaaagaatggccattagcggggatgattgcgtagtgaaaccaattgatgacaggttcgctaatgccctgctcgctctgaacgatatgggaaaggttcggaaagacatacctcaatggcagccatcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7620 - RNA, 9873 nt, synthetic construct
  misc_feature 1..9873: note = derived and/or modified CDS sequence (wt) from DENV-3__FJ639793__SS-prME
  source 1..9873: mol_type = other RNA
acatcgctctgtctcatgatgatattgccagcaacacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaaaaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgaaataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcagggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctatcgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggaaaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccaccagtgagaaagaagagaacatggtaaagtctctagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaagacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagccatgggagttccacctctaccactttttatttttagcttaaaagacacactcaaaaggagaagctggccactgaatgaaggggtgatggctgttgggcttgtgagcattctggctagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaagtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaagatagtgggactgtatggcaatggagtggttacaaagaatggtggctacgttagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcaactcagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgccctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcgaatgtgtccctggcagctatagccaaccaggcagtggtcctgatgggtttggacaaagggtggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctgttatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtaattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaagaaagtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaatcctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggtgccatttggtaa

SEQ ID NO: 7621 - RNA, 9873 nt, synthetic construct
  misc_feature 1..9873: note = derived and/or modified CDS sequence (wt) from DENV-3__FJ639795__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacgtgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaactcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggttttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcttggaatgtgtgggaggtggaagattacgggttcggagtcttcacaaccaacatatggctgaaactccgagaggtgtatacccaactatgtgaccacaggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcattacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtgcccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacctgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagtgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcattggacggaagcaaaaatgctgctggacaacattaacacaccagaagggatcataccagctctctttgagccagaaagggagaagtcagccgccatagacggtgagtatcgcctgaaaggtgagtccaggaagaccttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcacacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctggatcctgtaatatatgattcaaaatttgaaaagcaactgggacaggttatgctcctggttttgtgtgcagttcagcttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatgggtggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccctacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacctaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggataccagaacacccaggtccatgccaggaacaagaagggttatggggatcacagcggagtggctctggagaaccctgggaaggaataaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagtttgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagcggacaggtaggaacttatggtctgaatacattcaccaacatggaagcccagttaatcagacaaatggaaggagaaggtgtgctgttaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtactttcacagaagagacctcagactagcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7622 - RNA, 9873 nt, synthetic construct
  misc_feature 1..9873: note = derived and/or modified CDS sequence (wt) from DENV-3__FJ639798__SS-prME
  source 1..9873: mol_type = other RNA
acatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctagaaccagtagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaatgccttgaagatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggaaaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaagtcacataccctttggagcaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgcttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcacttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaggcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcagaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagctagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcactgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaatcttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcccacacacctagctcatagaacgagaaacgctctggacaatctggtgatgctgcacacgtcagaacatggcggtaaggcctacaggcacgcggtggaggaactaccagagacaatggaaacacttctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagacttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttgatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggagagagtttgacctttacaagaaatctggaatcactgaagtggatagaacagaagccaaagaagggttgaaaagaggagaaataacacaccatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatacggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggtcgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatattaatgcggaaccagaaacacccaacatggatgtcattggggaaagaataaaaaggatcaaggaggagcataattcaacatggcactatgatgaagaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggcccatgccaggaacaagaagggttatggggatcacagcggagtggctctggagaaccctgggaaggaacaaaaaacccaggttatgcacaagggaagagtttacaaaaaaggtcagaactaacgcagctatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggctgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacacgaataacagaagatgacctgcacaatgaggaaaagatcacacagcaaatggaccctgaacacaggcagttagcgaacgctatatttaagctcacataccaaaacaaagtggtcaaagttcaacggccgactccaacaggcacggtaatggacatcatatctaggaaagaccaaagaggcagtggacaggtaggaacttatggtctgaacacattcaccaacatggaagcccagttaatcagacaaatggaaggagaaggtgtgctgtcaaaggcagacctcgaaaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagttcactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctggggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7623 - RNA, 9873 nt, synthetic construct
  misc_feature 1..9873: note = derived and/or modified CDS sequence (wt) from DENV-3__FJ639799__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaataagcccacgttggatatagagcttcagaagaccgaggccacccaactggcgaccctaaggaagctatgcattgaggggaaaatcaccaacgtaacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtataaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagaacaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggtttggagtcttcacaaccaacatatggctgaaactccgagaagtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacatgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccaaactacaacaggagaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagtcagggttccaaactataacttgataataatggatgaagcccatttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctagggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggctcgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggacgtgttttatcttccacctgaaaagtgtgacaccctgttgtgcgacattggagaatcttcaccaagcccaacagtggaagaaagcagaactataagagttttgaagatggttgaaccatggctaaagaacaaccaattttgtattaaagtattgaacccttatatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggccagcagagagtctttaaagagaaagtggacaccaggacacccaggtccatgccaggaacaagaagggttatggggattacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7624 - RNA, 9873 nt, synthetic construct
  misc_feature 1..9873: note = derived and/or modified CDS sequence (wt) from DENV-3__FJ639800__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttacggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaagtccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgagaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaagttaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaacccgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggattgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagttacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaagaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcctatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtacgctgatgacacagctggttgggacacaagaataacagaagatgacctgcacaacgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtgaaaccaatcgatgacaggttcgctaatgccctgctcgctctgaacgatatgggaaaggttcggaaagacattcctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7625 - RNA, 9873 nt, synthetic construct
  misc_feature 1..9873: note = derived and/or modified CDS sequence (wt) from DENV-3__FJ639801__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagttgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattccattctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtctttacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatctttgggaaaacccaagtaggggttggagtacagaaagaaggagtctttcacaccatgtggcacgttacaagaggggcagtgttgacatgtaatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagctaatgaaatgggattgctggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatacgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaggttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtagaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaacccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccattcggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttaggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccctacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7626 - RNA, 9873 nt, synthetic construct
  misc_feature 1..9873: note = derived and/or modified CDS sequence (wt) from DENV-3__KF955471__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacggccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggggttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcaggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtaattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcaacttagtaggaagacttttgacacagaatatcagaaaactaaactgaatgattgggactttgtggtgacaactgacatttcagaaatgggagccaatttcaaagcagatagagtgatcgacccaagaagatgtctcaaaccagtgattctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaagatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggtatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttagaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtacgctgatgacacagctggttgggacacaagaataacagaagatgacctgcacaacgaggaaaagatcacacagcaaatggaccctgagcacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtaaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7627 - RNA, 9873 nt, synthetic construct
  misc_feature 1..9873: note = derived and/or modified CDS sequence (wt) from DENV-3__FJ639803__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacggccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggggttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacttggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaatacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccgtcaaggatgagagggctgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcactgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcaggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcgacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcggacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaagggatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtaattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcaacttagtaggaagacttttgacacagaatatcagaaaactaaactgaatgattgggactttgtggtgacaactgacatttcagaaatgggagccaatttcaaagcagatagagtgatcgacccaagaagatgtctcaaaccagtgattctgacagatggaccagagcgggtgatcctggctggaccaatgccagtcaccgcggcgagtgctgcgcaaaggagagggagagttggcaggaacccacaaaaagaaaatgaccaatacatattcacgggccagcctctcaacaatgatgaagaccatgctcactggacagaagcaaagatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgtttccagcggtatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttagaaactacaaagagagatttaggaatgtctaaggaaccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggacgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaaattaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggctcaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtacgctgatgacacagctggttgggacacaagaataacagaagatgacctgcacaacgaggaaaagatcacacagcaaatggaccctgagcacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtggtaaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagtcttagagaaaccgcatgtctggggaaagcctacgctcaaatgtggagtctcatgtattttcacagaagagacctcagactagcatccaatgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7628 - RNA, 9873 nt, synthetic construct
  misc_feature 1..9873: note = derived and/or modified CDS sequence (wt) from DENV-3__FJ639804__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgatgtggtgctcgagcacggggggtgtgtgaccaccatggctaagaacaaacccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacttacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgctgaagaaagaagtttcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaaaagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttgatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgacgtacccatggctggaccattagtagccgggggcttgctgatagcgtgttacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaagccaagtaggggttggagtacagaaagaaggagtctttcacaccatgtggcacgttacaagaggggcagtattgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaacggtggctacgtcagcggaatagcgcaaacgaatgcagaaccagatggaccgacaccagaattggaagaagaaatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggtaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaaggaattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaagaacagctgctggaataatgaagaatccaacggtggatgggataatgacaatagacctagatcctgtaatatatgattcaaaatttgaaaagcaactgggacaagttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactctacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaatagaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccagaatacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctatatactaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaagaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 7629 - RNA, 9873 nt, synthetic construct
  misc_feature 1..9873: note = derived and/or modified CDS sequence (wt) from DENV-3__FJ639805__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggctacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatcttggagctgtagtgcaagctgacatggggtgtgttataaactggaaaggtaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgcgaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcccatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcctcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctttaccactttttatctttaacttaaaagacacactcagaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactagatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatcgttagagaggcaatcaagagacgtttgagaactctaattctggcaccgacaagggtggttgcagctgagatggaagaagcactgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagatcatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggcaaggcctacaggcatgcggtggaggaactaccagagacaatggaaacactcctactcttgggactcatgatcttgttgacaggtggagcaatgcttttcttaatatcaggtaaagggcttggaaagacttcaataggactcatttgtgtaattgcttccagcggcatgttgtggatggccgaaatcccactccaatggatcgcgtcggccatagtcctggagttttttatgatggtgttgctgataccagaaccagaaaagcagagaaccccccaagacaaccaactcgcatatgtcgtgataggcatacttacattggcagcaataatagcagccaatgaaatgggattgttggaaactacaaagagagatttaggaatgtctaaagaaccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcatccccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagagagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgatacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcagggagcgggatggagtcttagagaaaccgcatgtctgggaaaagcctacgctcaaatgtggagtctcatgtattttcacagaagagacctcagattagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7630 - RNA, 9873 nt, synthetic construct
  misc_feature 1..9873: note = derived and/or modified CDS sequence (wt) from DENV-3__FJ639807__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagttgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagctatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattccattctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctatggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtctttacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctacaggatcaaacagcaaggaatctttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagatcgttgatctgatgtgccacgcaacgttcacaatgcgtctgctgtcaccagttagggttccaaactataacttgataataatggatgaagcccatttcacagacccagccagcatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaagaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagctaatgaaatgggattgctggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatacgattcaaaatttgaaaagcaactgggacaggttatgctcctggttttgtgtgcagttcaacttttgttaatgagaacatcatgggccttgtgtgaagctttaactctagccacaggaccaataacaacactctgggaaggatcacctgggaagttttggaacaccacgatagctgtttccatggcgaacatttttagagggagctatttagcaggagctgggcttgctttttctatcatgaaatcagttggaacagggaaaagaggaacaggctcacagggtgaaactttaggagaaaaatggaaaaagaggttaaatcaattatcccggaaagagtttgacctttacaagaaatctggaatcactgaagtggatagaacagaagccaaagaagggttgaaaaggggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacccatgtccacatatggatggaacatagtcaagttaatgagtggaaaggatgtgttttatcttccacctgaaaagtgtgacaccctgttgtgtgacattggagaatcttcaccaagcccaacagtagaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccattcggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaagttgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttgaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccctacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7631 - RNA, 9873 nt, synthetic construct
  misc_feature 1..9873: note = derived and/or modified CDS sequence (wt) from DENV-3__FJ639810__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagttgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgttcttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagatccctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggctaatgtcggcagccgttaaggatgaaagggccgtacatgctgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttattcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaattgataacacaatttgaaacataccaattatggacagcattaatctccttaacgtgttcgaatacaattttcacgttgactgttgcctggagaacagccaccctgattttggccggagtttcacttttaccagtgtgccagtcttcgagcatgaggaaaacagactggcttccaatgacagtggcagctatgggagttccacctctaccactttttattttttgcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttctgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcagaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcagacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggtcgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcgaaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcatgccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagctacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaaatgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgtacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacggaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7632 - RNA, 9873 nt, synthetic construct
  misc_feature 1..9873: note = derived and/or modified CDS sequence (wt) from DENV-3__FJ639816__SS-prME
  source 1..9873: mol_type = other RNA
acatcgctctgtctcatgatgatattgccagcaacacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaaaaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggaaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgaaataacacctcaggcatcaaccactgaagccatcttgcctgaatatggaactcttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcagggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatgaacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagccgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggaaaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcaaggaaaaagaacactaacaccacaacccatggagctaaaatactcatggaaaacgtggggaaaggcaagaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcctgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggccatggcaacaacgttacaactgccagaagacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagccatgggagttccacctctaccactttttatttttagcttaaaagacacactcaaaaggagaagctggcctctgaatgaaggggtaatggctgttgggcttgtgagcattctggctagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatattccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaagtgcaggttattgccgtagagcctgggaagaacccaaagaactttcaaaccatgccaggcacttttcagaccacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaactataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacggaaaaaaggtcattcagctcagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggacgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgccctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatatgtagtgataggcatacttacattggcagcaacaatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaagggtggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctgttatgaaatcagttggaacagggaaaagaggaacaggctcacagggcgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaagcttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtaattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtctatgccaggaacaagaagggttatggggatcacagcggagtggctctggagaaccctgggaaggaacaaaaaacccaggttatgcacaagggaagagtttacaaaaaaagtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatctccaagatacccggaggagctatgtatgctgacgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaatcctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgtagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggtgccatttggtaa

SEQ ID NO: 7633 - RNA, 9873 nt, synthetic construct
  misc_feature 1..9873: note = derived and/or modified CDS sequence (wt) from DENV-3__FJ639817__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttattttcatactactaatgctggtcaccccatccatgacaatgagatgtgtgggagtaggaaatagagattttgtggaaggtctatcaggagctacgtgggttgacgtggtgctcgagcacggggggtgtgtgaccaccatggctaagaataagcccacgttggatatagagcttcagaagaccgaggccacccaactggcgaccctaaggaagctatgcattgaggggaaaatcaccaacgtaacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcgggacacttaaaatgtagacttaagatggacaaattagaactcaaggggatgagctatgcaatgtgcacgaatacctttgtgttgaagaaagaagtctcagaaacgcagcatgggacaatactcatcaaggtcgagtataaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcatgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaagaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagaacaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggtttggagtcttcacaaccaacatatggctgaaactccgagaagtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttatgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatctattgttaggagttgggctggctatggcaacaacgttacaactgccagaggacattgaacaaatggcaaatggaatcgctctggggctcatggctcttaaactgataacacaatttgaaacataccaattatggacagcattaatctccttgacatgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaggatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcactttccaaactacaacaggagaaataggagcaattgcactggatttcaagcctggaacttcaggatctcctatcataaacagagagggaaaggtagtgggtctgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagtcagggttccaaactataacttgataataatggatgaagcccacttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcatcaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctagggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacccgggaagttttggaacaccacgatagctgtttccatggcgaacatttttagagggagctatttagcaggagctgggctcgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacggaagtgcgaggatacacaaaaggcggtccaggacacgaagaaccagtacctatgtccacatatggatggaacatagtcaagttaatgagtggaaaggacgtgttttatcttccacctgaaaagtgtgacaccctgttgtgcgacattggagaatcttcaccaagcccaacagtggaagaaagcagaactataagagttttgaagatggttgaaccatggctaaagaacaaccaattttgtattaaagtattgaacccttatatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagacacaactccatttggtcagcagagagtctttaaagagaaagtggacaccaggacacccaggtccatgccaggaacaagaagggttatggggattacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaactgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagtccaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctactcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7634 - RNA, 9873 nt, synthetic construct
  misc_feature 1..9873: note = derived and/or modified CDS sequence (wt) from DENV-3__FJ639825__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaatcaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaatggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggaacttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgactacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaattaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagcgcctcaagagcatggaatgtgtgggaggtggaagattacgggttcggagtcttcacaaccaacatatggctgaaactccgagaggtgtatacccaacaatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtcgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccggaggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttagtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtacaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgattgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagctatgcttttcttaatatcaggcaaagggattggaaagacttcaataggactcatttgtgtaatcgcttccagtggcatgttgtggatggccgaaatcccactccaatggatcgcgtcggccatagtcctggagttttttatgatggtgctgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggttctgatgggtttggacaaaggatggccaatatcaaaaatggacttaggagtacccctgctggcattaggttgctattcacaagtgaacccactgactctaacagcggcagtactcttgctgatcacacattatgctattataggtccaggactgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccatcgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaagcccaggttgtgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaagcagttagcgaacgctatatttaaactcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7635 - RNA, 9873 nt, synthetic construct
  misc_feature 1..9873: note = derived and/or modified CDS sequence (wt) from DENV-3__FJ639826__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggttaatgtcggcagccgtcaaggatgaaagggccgtacatgccgacatgggctattggatagaaagtcaaaagaatggaagttggaagctagaaaaagcatccctcatagaggtgaaaacctgcacatggccaaaatcacataccctttggagtaatggtgtgttagagagtgacatgatcattccaaaaagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagaaaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctctcaaactgataacacaatttgaaacataccaactatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtgtcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcactgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccttagcactcaaggaattcaaggactttgcggctggcaggaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacactggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattccacagcaaatgtgtccttggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaggtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgcgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactacgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccataagtggggatgactgcgtggtgaaaccaatcgatgacaggttcgctaatgccctgctcgctctgaacgacatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagagtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggttagaagccttataggcaatgaagagtttctggactacatgccttcaatgaagagatttaggaaggaggaggagtcggagggagccatttggtaa

SEQ ID NO: 7636 - RNA, 9873 nt, synthetic construct
  misc_feature 1..9873: note = derived and/or modified CDS sequence (wt) from DENV-3__FJ810416__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaacggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcatcgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcatcccaaagagtctagctggtcctatctcgcaacacaactacaggcccgggtaccacacccagacggcgggaccctggcatttaggaaaattagagctggacttcaattattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggataacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgttgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttatgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttgggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccaatcacaacctgggaaaatgttccatatctagggaagagagaagaccaatggtgcggatcactcattggtctcacttctagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7637 - RNA, 9873 nt, synthetic construct
  misc_feature 1..9873: note = derived and/or modified CDS sequence (wt) from DENV-3__GQ252678__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacaggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcggcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaggcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttattggtctcacttccagagcaacctgggcccagaacatatccacagcaattcaacaggtgagaagccttataggcaatgaagagtttctggactacatgccttcaatgaagagatttaggaaggaggaggagtcggagggagccatttggtaa

SEQ ID NO: 7638 - RNA, 9873 nt, synthetic construct
  misc_feature 1..9873: note = derived and/or modified CDS sequence (wt) from DENV-3__FJ850098__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacacagcatgggacaatactcatcaaggtcgagtacaaaggggaagatgtaccttgcaagattcctttctccacagaggatggacaagggaaagctcacaatggcagactgattacagccaacccagtggtgactaagaaggaggatcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactcccccaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatgtaattggggtcttagagcaaggaaaaagaacactaacactacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggatttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaactcaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcttggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacggaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctgctgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7639 - RNA, 9873 nt, synthetic construct
  misc_feature 1..9873: note = derived and/or modified CDS sequence (wt) from DENV-3__KF955479__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttctcgcccattacataggcacttccttgacccagaaggtggttatttttatactactaatgctggttaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggcttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccttcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagctatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatagtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaagtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgcttgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7640 - RNA, 9873 nt, synthetic construct
  misc_feature 1..9873: note = derived and/or modified CDS sequence (wt) from DENV-3__FJ850109__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctacttttcaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacacaggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaactccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaattatgtgaccataggctaatgtcggcagccgtcaaggatgaaagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagctgacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacgggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccctagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctataggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttgagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattacgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcatgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgatacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactatatgccttcaatgaagagatttaggaaggaggaggaatcggagggagccatttggtaa

SEQ ID NO: 7641 - RNA, 9873 nt, synthetic construct
  misc_feature 1..9873: note = derived and/or modified CDS sequence (wt) from DENV-3__GQ868586__SS-prME
  source 1..9873: mol_type = other RNA
acatcgctctgtctcatgatgatattgccagcagcacttgctttccacttgacttcacgagatggagagccgcgcatgattgtggggaaaaatgaaagaggaaaatccctactttttaagacagcctctggaatcaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaatggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggaacttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattagaactcaaggggatgagctatgctatgtgcacgaatacctttgtgttgaagaaagaagtctcagaaacgcagcatgggacaatactcatcaaggtcgactacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaattaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcaataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagctaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagcgcctcaagagcatggaatgtgtgggaggtggaagattacgggttcggagtcttcacaaccaacatatggctgaaactccgagaggtgtatacccaacaatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagtcgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacattcaaaatccagccattcttggctttgggatttttcctaagaaaactgacatccagagaaaatttattgctaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtaagcattctggccagttctctccttagaaatgatgtacccatggctggaccattagtggccggaggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccataccagcaacattgttagtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtacaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagccgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgattgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacatcaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagctatgcttttcttaatatcaggcaaagggattggaaagacttcaataggactcatttgtgtaatcgcttccagtggcatgttgtggatggccgaaatcccactccaatggatcgcgtcggccatagtcctggagttttttatgatggtgctgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggttctgatgggtttggacaaaggatggccaatatcaaaaatggacttaggagtacccctgctggcattaggttgctattcacaagtgaacccactgactctaacagcggcagtactcttgctgatcacacattatgctattataggtccaggactgcaggcaaaagccactcgtgaagctcagaaaaggacagctgctggaataatgaagaatccaacggtggatgggataatgacaatagacctagatcccgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaagtaacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccatcgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaagcccaggttgtgcacaagggaagagtttacaaaaaaggtcagaactaacgcagccatgggagccgttttcacagaggagaaccaatgggacagcgcgaaagctgctgttgaggatgaggatttttggaaacttgtggagagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaagcagttagcgaacgctatatttaaactcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatgggagaaagttggtggttccctgcagaccccaggacgaactaataggaagagcaagaatctctcaaggagcgggatggagccttagagaaaccgcatgtctggcgaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgtggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7642 - RNA, 9873 nt, synthetic construct
  misc_feature 1..9873: note = derived and/or modified CDS sequence (wt) from DENV-3__FJ850110__SS-prME
  source 1..9873: mol_type = other RNA
acatcgctctgtctcatgatgatattgccagcagcactggctttccacttgacttcacgagatggagagccgcgcatgattgtggggaagaatgaaagaggaaaatccctactttttaagacagcctctggaattaacatgtgcacactcatagccatggacctgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacataggcacttccttgacccagaaggtggttatttttatactgctaatgttggtcaccccatccatgacaatgagatgtgtgggagtaggaaacagagattttgtggaaggactatcaggagctacgtgggttgacgtggtgctcgagcacggggggtgtgtgaccaccatggctaagaacaaacccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcatactgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaactatgtgaccataggctaatgtcggcagccgtcaaggatgaaagggccgtacatgccgacatgggctattggatagaaagccaaaagaatggaagttggaagctagaaaaagcatccctcatagaggtgaaaacctgcacatggccaaaatcacataccctttggagcaatggtgtgttagagagtgacatgatcattccaaagagtctagctggtcctatctcgcaacacaactacaggcctgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagatggttgctggtatggcatggaaatcagacccatcaatgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagacatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagacgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttttatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcccggaacttcaggatctcctatcataaacagagagggaaaggtagtgggactgtatggcaatggagtggtcacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataaccaaattttagaagagaacatggatgtggaaatctggacaaaggaaggagaaaagaaaaaattgagacctaggtggcttgatgctcgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtatctccaaccagctatttagatgtggacttgcacccagcatcagcctggacattgtacgctgtggccactacagtaataacaccaatgttgagacataccatagagaattctacagcaaatgtgtccctggcagctatagccaaccaagcagtggtcctgatgggtttggacaaaggatggccaatatcaaaaatggacttaggagtacccctgctggcattgggttgctattcacaagtgaacccactgactctaacagcggcagtactcttgctgatcacacattatgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaagtctggaatcactgaagtggatagaacagaagccaaagaagggttgaaaagaggagaaataacacatcatgccgtgtccagaggtagtgcaaaacttcaatggtttgtggaaagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccagttttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggttagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaattcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagacggaagaaagttggtggttccctgcagaccccaggacgaactaataggaagagcaagaatctcccaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7643 - RNA, 9873 nt, synthetic construct
  misc_feature 1..9873: note = derived and/or modified CDS sequence (wt) from DENV-3__FJ850111__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctacttttcaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggatacacgcacccaaacttggatgtcggctgaaggagcttggaggcaagtcgagaaggtagagacatgggcccttaggcacccagggttcaccatactagccctatttcttgcccattacataggcacttccttgacccagaaggtggttatttttatactgctaatgctggtcaccccatccatgacaatgagatgtgtgggagtaggaaacagagattttgtggaaggactatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccaaaactacgtgtgtaagcatacatacgtagacagaggctgggggaacggatgtggtttgtttggtaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgttcttgggtcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagcaatatagtaattggaattggagacaactccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacacggggtgtgttataaactggaaaggcaaagaactcaagtgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggttgttgtgggcgatataattggggtcttagagcaagggaaaagaacactaacaccacaacccatggagctaaaatactcatggaaaacgtggggaaaggcaagaatagtgacagctgaaacacaaaattcttctttcataatagatggaccaaacacaccggagtgtccaaatacctcaagagcatggaatgtgtgggaggtggaagattacgggttcggagtcttcacaaccaacatatggctgaaactccgagaggtgtatacccaattatgtgaccataggctaatgtcggcagccgtcaaggatgaaagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaatgcaactgacaggatgggaatgggcgtcacctacctagctttaattgcaacatttaaaatccagccatttttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggctggagtttcacttttaccagtgtgccagtcttcgagtatgaggaaaacagactggcttccaatgacagtggcagctatgggagttccacctctaccacttttcatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacgggggaaataggagcaattgcactggatttcaagcccggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccaacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaatattcatgacagcaacgccccctggaacagctgatgcctttccccagagcaacgctccaattcaagatgaagaaagggacataccagaacgctcatggaattcaggcaatgaatggataaccgacttcgctgggaaaacggtgtggtttgtccccagcattaaagccggaaatgacatagcaaattgcctgcggaaaaacgggaaaaaggtcattcaacttagtaggaagacttttgacacagaatatcagaaaaccaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcagcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgctcgcacctattcagatcccctagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctataggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagagaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttgagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattacgccattataggtccaggattgcaggcaaaagccacccgtgaagctcagaaaaggacagctgctggaataatgaagaatccaacagtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaaccctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttgggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagtgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttctatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccagctgtgattgagcacctagaaagactacaaaggaaacatggaggaatgcttgtgagaaatccactttcacgaaactccacgcatgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgatacagatggcaatgacagatacaactccatttggccagcagagagtctttaaagagaaagtggacaccaggacacccaggtccatgccaggaacaagaagggttatggagatcacagcggagtggctctggagaaccctgggaaggaataaaaaacccaggttatgcacaagggaagagtttacaaaaaaggtcagaactaacgcagccatgggagctgttttcacagaggagaaccaatgggacagcgcgaaagctgctgttgaggatgaggatttttggaaacttgtggacagagaacgtgaactccacaaactgggcaagtgtggaagctgtgtttacaacatgatgggtaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggatatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgactgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcacgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactatatgccttcaatgaagagatttaggaaggaggaggaatcggagggagccatttggtaa

SEQ ID NO: 7644 - RNA, 9873 nt, synthetic construct
  misc_feature 1..9873: note = derived and/or modified CDS sequence (wt) from DENV-3__KF955486__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgattgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttacactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaaaggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgattctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattctagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcgcgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgtttttacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcgcttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7645 - RNA, 9873 nt, synthetic construct
  misc_feature 1..9873: note = derived and/or modified CDS sequence (wt) from DENV-3__FJ898468__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatgtaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagctgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7646 - RNA, 9873 nt, synthetic construct
  misc_feature 1..9873: note = derived and/or modified CDS sequence (wt) from DENV-3__FJ898469__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtatcaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggcttacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgctggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccttgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcggcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7647 - RNA, 9873 nt, synthetic construct
  misc_feature 1..9873: note = derived and/or modified CDS sequence (wt) from DENV-3__FJ898470__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatacttatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggggtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagccttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaatgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggcaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgctggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaagagcataattcaacatggcactatgatgacgaaaacccctacaaaacgtgggcttaccatggatcttatgaagtcaaagccacaggctcggcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccagcaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7648 - RNA, 9873 nt, synthetic construct
  misc_feature 1..9873: note = derived and/or modified CDS sequence (wt) from DENV-3__FJ898471__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacccgaagacattgactgctggtgcaacctcacatcaacatgggtaacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgatccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgcggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcctgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgtaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagagaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagtcgggctggctatggcaacaacgttacaactgccagaggacattgaacaaatggcaaatggaatcgctctggggctcatggctcttaaactgataacacaatttgaaacataccaattatggacagcattagtctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagccttgaaagggctcccaataaggtaccaaacaacagcaacaaaatctgaacacacaggaagagagattgttgatctgatgtgccacgcaacgttcacaatgcgtctgctgtcaccagttagggttccaaactacaacttgataataatggatgaagcccatttcacagacccagccagtatagctgctagagggtacatatcaactcgtgttgggatgggagaagcagccgcaattttcatgacagcaacgccccctggaacagctgatgcctttcctcagagcaacgctccaattcaagatgaagaaagggacataccagaacgctcatggaattcaggcaatgaatggataaccgatttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagaacgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtctaggaagactttcgtggaactcatgaggaggggtgaccttccagtctggttagcctataaagtagcatcagaagggatcaaatatacagatagaaaatggtgctttgatggacagcgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccggagacaatggaaacactcctactcttgggactcatgatcttgttgacaggtggagctatgcttttcttgatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatatgttgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaaaaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacaatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcagaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttctggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacatttaccaacatggaagcccagttgatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatacctagggaagagagaagaccaatggtgcggatcacttattggtctcacttccagggcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7649 - RNA, 9873 nt, synthetic construct
  misc_feature 1..9873: note = derived and/or modified CDS sequence (wt) from DENV-3__FJ898472__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagctatggacttgggagagatgtgtgatgacacggtcacttacaaatgcccccatattaccgaagtggaacctgaagacattgactgctggtgtaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggacatagagcttcagaagaccgaggccacccaactggcgaccctaagaaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaagcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagccacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtagtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggtgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaagtactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccttggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcctcacgtttgtactccttctctcagggcaaataacatggagagatatggcgcacacactaataatgattgggtccaacgcatctgacaggatgggaatgggcgttacctacctagctttaattgcaacatttaagatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactagatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatcgttagagaggcaatcaagagacgtttgagaactctaattctggcaccgacaagggtggttgcagctgagatggaagaagcattgaaaggactcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatacacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctgataccagaaccagaaaagcagagaaccccccaagacaaccaactcgcatatgtcgtgataggcatacttacattggcagcaataatagcagccaatgaaatgggattgttggaaactacaaagagagatttaggaatgtctaaagaaccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagagagactacaaaggaaacatggaggaatgcttgtgagaaatccactttcacgaaactccacgcacgaaatgtactggatatctaatggcacaggtaacattgttgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatattcaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcagggagcgggatggagtcttagagaaaccgcatgtctgggaaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7650 - RNA, 9873 nt, synthetic construct
  misc_feature 1..9873: note = derived and/or modified CDS sequence (wt) from DENV-3__FJ898474__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtgacttacaaatgcccccacattactgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccctgacccagaaggtggttatttttatactactaatgctggtcaccccatccatgacaatgagatgtgtgggagtaggaaacagagattttgtggaaggtctatcaggagctacgtgggttgacgtggtactcgagcacggggggtgtgtgaccaccatggctaagaacaagccaacgttggatatagagcttcagaagaccgaggccacccaattggcgaccttaaggaagctatgcattgaggggaaaattaccaacataacaactgactcaagatgtcctacccaaggggaagcggctttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcgaccactgaagccatcttgcctgaatatggaacccttgggctagaatgctcaccacggacaggcttggatttcaatgaaatgatcttgctaacaatgaagaacaaagcatggatggtacatagacaatggttttttgacctacctctaccatggacatcaggagctacaacggaaacaccaacctggaacaggaaggaacttcttgtgacattcaaaaacgcacatgcgaaaaaacaagaagtagttgtccttggatcgcaagagggagcaatgcacactgcattgactggagccacagaaatccaaaactcaggaggcacaagtatttttgcggggcacttaaaatgcagacttaagatggacaaattggaactcaaaggaatgagctatgcaatgtgcacgaatacctttgtgttgaagaaagaagtctcagaaacgcagcatgggacaatactcattaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggagagcaatatagtgattggaattggagacaacgccttgaaaatcaactggtataagaagggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatctttgtcaccaacgaggtccatacctggacagagcaatacaaattccaagcagactccccaaaaagactggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgacataattggggtcttagagcagggaaaaagaacactaacaccacaacccatggagctaaaatactcatggaaaacgtggggaaaggcaaaaataatgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagccattaaggatgagagggccgtacatgccgacatgggctattggatagaaagccaaaagaatggaagttggaagctagaaaaagcatccctcatagaggtaaaaacctgcacatggccaaaatcacatactctttggagtaatggtgtgctagagagtgacatgatcatcccaaagggtctagctggtcctatttcgcaacacaaccacaggcctgggtatcacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcctttgcgatacataggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagagacatggcgcacacactaataatgattgggtccaacgcatctgacaggatgggaatgggcgttacctacctagctttaattgcaacatttaaaattcagccattcttggctttgggatttttcctaagaaaactgacatccagagaaaatttattgttaggagttgggctggctatggcaacaacgttacaactgccagaggacattgaacaaatggcaaatggaatcgccctggggctcatggctcttaaactgataacacaatttgaaacataccaattatggacagcattaatctccttaacgtgttcaaatacgatttttacgttgactgttgcctggagaacagccaccctgattttggccggagtttcgcttttaccagtgtgccagtcttcgagcatgaggaaaacagactggcttccaatggcagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaggatgatgagactgagaatatcctaacagtgcttttgaaaacagcattactaatagtatcaggaatctttccatactccatacccgcaacattgttggtctggcatacttggcaaaagcaaacccaaagatccggcgttctatgggacgtacccagccccccagagacacagaaagcagaactggaagaaggggtctataggatcaaacagcaaggaatttttggaaaaacccaagtaggggttggagtacagaaagaaggagtcttccacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagaccataacaggggaaattggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaattataacttgataataatggatgaagcccatttcacagacccagccagtatagcggctagagggtacatatcaactcgtgttggaatgggagaggcagccgcaattttcatgacagcaacgccccctggaacagctgatgcctttcctcagagcaacgccccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtagaaagacttttgacacagaatatcagaaaactaaactgaatgattgggacttcgtggtgacaactgacatttcagaaatgggggccaatttcaaagctgatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaatacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaggaattcaaggactttgcggctggcagaaagtcaattgcccttgatcttgtgacagaaataggaagagtgccttcacacctagcccatagaacgagaaatgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggctatagtcctggagttctttatgatggtgttgcttataccagaaccagaaaagcagagaactccccaagacaaccaactcgcatatgtcgtgataggcatactcacattggctgcaataatagcagccaatgaaatgggattgctggaaactacaaagagagatttaggaatgtctaaggagccaggtgttgtctctccaaccagctatttagatgtggacttgcacccagcatcagcctggacattgtacgccgtggccactacagtaataacaccaatgttaagacataccatagagaattccacagcaaatgtgtccttggcagctatagccaaccaggcggtggtcctgatgggtttggacaaaggatggccaatatcaaaaatggacttaggagtacccctactggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagtccaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtaggaacagggaaaagaggaacaggctcacaaggtgaaactttaggagaaaaatggaaaaagaagttaaatcaattatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacatgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaaggcccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacatgggcttatcatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccctgggaaggaacaaaaaacccaggttgtgcacaagggaagagtttacaaagaaggtcagaactaacgcagccatgggcgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggatatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcaggcaaatggaaggagaaggtgtgctgtcaaaggcagacctcgagagccctcatctgccagagaagaaaattacacaatggttggaaaccaaaggagtggagaggttaaaaagaatggccattagcggggatgattgcgtagtgaaaccaatcgatgataggttcgctaatgccctgctcgctctgaacgatatgggaaaggttcggaaagacatacctcaatggcagccatcaaagggatggcatgattggcaacaggttcctttctgctctcaccactttcatgaattgatcatgaaagatggaagaaagttggtagttccctgcagaccccaggacgaactaataggaagagcaagaatttctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccagtggtgcggatcacttattggtctcacttccagagcaacctgggcccagaacatacccacagcaattcaacaggtgagaagccttataggcaatgaagagtttctggactatatgccttcaatgaagagatttaggaaggaggaggagtcggagggagccatttggtaa

SEQ ID NO: 7651 - RNA, 9873 nt, synthetic construct
  misc_feature 1..9873: note = derived and/or modified CDS sequence (wt) from DENV-3__EU529688__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggtaatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctgacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccaggatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatctttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7652 - RNA, 9873 nt, synthetic construct
  misc_feature 1..9873: note = derived and/or modified CDS sequence (wt) from DENV-3__EU482613__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccttatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaggctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgccctggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagaatttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactacacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7653 - RNA, 9873 nt, synthetic construct
  misc_feature 1..9873: note = derived and/or modified CDS sequence (wt) from DENV-3__EU529690__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatataccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagactcaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaaaggaagctctattgggaagatgttcgaggccactgctagaggtgcaaggcgcatggccatcttgggagacacagcttgggactttggatcagtgggtggtgttctgaactcattaggtaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacacggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgctgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagcccatagaacgagaaacgctctggacaatctggtgatgctgcatacgtcagaacatggcggcaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggatatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7654 - RNA, 9873 nt, synthetic construct
  misc_feature 1..9873: note = derived and/or modified CDS sequence (wt) from DENV-3__EU529691__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctgctttttaagacagcctctggaattaacatgtgcacactcatagccatggacttgggagagatgtgtgatgacacggtcacttacaaatgcccccacattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactagacacacgcacccaaacctggatgtcggctgaaggagcttggaggcaagtcgagaaggtagagacatgggcccttaggcacccagggttcaccatactagccctatttcttgcccattacataggcacatccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgactaccatggctaagaacaagccaacgttggatatagagcttcagaagaccgaggccacccaattggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcatacaggagatcaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaagaaacaagaagtagttgtccttggatcgcaagagggagcaatgcataccgcattgacaggagccacagaaatccaaaactcaggaggcacaagtatttttgcggggcacttaaaatgtagacttaagatggacaaattggaactcaaggggatgagctatgcaatgtgcacgaatacctttgtgttgaagaaagaagtctcagaaacgcagcatgggacaatactcattaaggtcgagtacaaaggggaagatgcaccttgcaagattcctttctccacagaggatggacaagggaaagctcacagtggcagactgattacagccaacccagtggtgactaagaaggaggagcctgtcaatattgaggctgaacctccttttggggaaagtaatatagtgattggaattggagacaacgccttgaaaatcaactggtataagaaaggaagctctattgggaagatgttcgaggccactgccagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaatcggaataggagttctcttgacttggatagggttgaattcaaaaaacacatccatgtcattttcatgcattgcggtaggaatcatcacactctatctgggagctgtggtgcaagctgacatgggatgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaactagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagacgggccaaacacaccggagtgtccaagtgcctcaagagcatggaatgtgtgggaggtggaagattacgggttcggagtcttcacaaccaacatatggctgaaactccgagaggtgtacacccaactatgtgaccataggctaatgtcggcagctgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgctagagagtgacatgatcatcccaaagagtctagctggtcctatttcgcaacacaaccacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgttcgtgcacacttcctcccttgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtgctccttctctcagggcaaataacatggagggacatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatgtttacgttgactgttgcctggagaacagccaccctgattttggccggagtttcgcttttaccagtgtgccagtcttcgagcatgaggaaaacagactggcttccaatggcagtggcagccatgggagttccacctctaccactttttatttttagcttgaaagacacacttaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatataacatgggaggaagaggctgagcaaacaggagtgtcccacaacttaatgatcacagttgatgatgatggaacaatgagaataaaagatgatgagactgagaatatcctaacagtgcttttgaaaacagcattactaatagtatcaggagtctttccatactccatacccgcaacattgctggtctggcatacttggcaaaagcaaacccaaagatccggcgttctatgggacgtacccagccccccagagacacagaaagcagaactggaagaaggggtctataggatcaaacagcaaggaatttttgggaaaacccaagtaggggttggagtacagaaagaaggagtcttccacaccatgtggcacgtcacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttaagaactctaattttggcaccgacaagggtggttgcagctgagatggaagaagcattgaaagggctcccaataaggtaccaaacaacagcaacaaaatctgaacacacaggaagagagattgttgatctaatgtgccacgcaacgttcacaatgcgtctgctgtcaccagttagggttccaaactataacttgataataatggatgaagcccatttcacagacccagccagtatagcggctagagggtacatatcgactcgtgttggaatgggggaggcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacaactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaacgatgaagaccatgctcactggacagaagcaaaaatgctgctggacaacattaatacaccagaagggatcataccagctctctttgagccagaaagggagaagtcagccgccatagatggtgagtatcgcttgaaaggtgagtctaggaagactttcgtggaactcatgaggaggggtgaccttccagtctggttagcccataaagtagcatcagaagggatcaaatatacagatagaaaatggtgctttgatggacaacgtaataatcaaattttagaggagaacatggatgtggaaatctggacaaaggaaggagaaaagaaaaaattgagacctaggtggcttgatgcccgcacttattcagatcccttagcactcaaagaattcaaggactttgcggctggcagaaagtcaatcgcccttgatcttgtgacagaaataggaagagtgccttcacacctagcccatagaacgagaaatgctctggacaatctggtgatgctgcatacgtcagaacatggcggtagggcctacaggcatgcggtggaggaactaccagagacaatggaaacactcctactcttgggactcatgatcttgttgacaggtggagcaatgcttttcttaatatcaggtaaagggattggaaagacctcaataggactcatttgtgtaattgcttccagcggcatgttgtggatggccgaaatcccactccaatggatcgcgtcggctatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgccgtggccactacagtaataacaccaatgttaagacataccatagagaattctacagcaaatgtgtctctggcagctatagccaaccaggcagtggtcctgatgggtttggacaaaggatggccaatatcaaaaatggacttaggagtacccctactggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttctctattatgaaatcagttggaacaggaaaaagaggaacaggctcacaaggtgaaactttaggagaaaaatggaaaaagaaattaaatcaattatcccggaaagagtttgacctttacaagaaatctggaatcactgaagtggatagaacagaagccaaagaagggttgaaaagaggagaaacaacacatcatgccgtgtccagaggtagcgcaaaacttcaatggtttgtggagagaaacatggtcattcccgaaggaagagtcatagacttgggctgtggaagaggaggctggtcatattactgtgcaggactgaaaaaagtcacagaagtgcgaggatacacaaaaggcggtccaggacacgaagaaccagtacctatgtccacatatggatggaacatagttaagttaatgagtggaaaggatgtgttttatcttccacctgaaaagtgtgacaccctgttgtgtgacattggagaatcttcaccaagcccaacagtggaagaaagcagaaccataagagttttgaagatggttgaaccatggctaaagaacaaccaattttgcattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaatatggtatctagactgctactgaacaggttcacgatgacgcacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaacggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggtcatggggatcacagcggagtggctctggagaaccttgggaaggaacaaaaaacccaggttatgcacaagggaagagtttacaaaaaaggtcagaactaacgcagccatgggtgccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagccatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7655 - RNA, 9873 nt, synthetic construct
  misc_feature 1..9873: note = derived and/or modified CDS sequence (wt) from DENV-3__EU569689__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgtatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaagcgtggggaaaggcaaaaatagtgacagctgaaacacaaaattcttctttcataatagatggaccaaacacaccggagtgtccaagtgcctcaagagcatggaatgtgtgggaggtggaagattatgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatttggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaactatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatctccatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaacttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaagcaaaagccactcgtgaagctcaaaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactctcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcattatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgccaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatatctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7656 - RNA, 9873 nt, synthetic construct
  misc_feature 1..9873: note = derived and/or modified CDS sequence (wt) from DENV-3__EU482614__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtacaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaacatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcatcctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctacttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaatgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagatctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7657 - RNA, 9873 nt, synthetic construct
  misc_feature 1..9873: note = derived and/or modified CDS sequence (wt) from DENV-3__EU569690__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagtttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggagcaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatgaacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaataccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccactctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttttatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactttaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctttttgagccagaaagggagaagtcagccgccatagacggtgagtatcgtctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgacgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcacgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacggcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatctgttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7658 - RNA, 9873 nt, synthetic construct
  misc_feature 1..9873: note = derived and/or modified CDS sequence (wt) from DENV-3__EU569691__SS-prME
  source 1..9873: mol_type = other RNA
acatcgctctgtctcatgatgatattgccagcagcacttgctttccacttgacttcacgagatggagagccgcgcatgattgtggggaagaatgaaagaggaaaatccctactttttaagacagcctctggaactaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgagggaaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccaccgctagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcctctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaaactagaaaaagcatccctcatagaggtgaaaacctgcacatggccaaaatcacataccctttggagtaatggagtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatttccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaccttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataacaggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacacataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctactggacaacatcaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttagacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacagaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttctaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccttgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggacgagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 7659 - RNA, 9873 nt, synthetic construct
  misc_feature 1..9873: note = derived and/or modified CDS sequence (wt) from DENV-3__EU482452__SS-prME
  source 1..9873: mol_type = other RNA
acatcgctctgcctcatgatgatgttaccagcaacacttgctttccacttgacttcacgcgatggagagccgcgcatgattgtggggaagaatgaaagagggaaatccttacttttcaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggccgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccaccatggctaagaacaagcctacgctggacatagagcttcagaagaccgaggccacccaactggcaaccctaaggaagttatgcattgaagggaaaattaccaacataacaactgactcaaggtgtcctacccaaggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcagtggttctttgacctacccctaccatggacatcaggagctacaacagagacaccaacttggaacaggaaagagcttcttgtgacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttagatacctttgtgttgaagaaagaagtctctgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaactcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaacctattgtggaagcaaatagccaatgagctgaactacatattatgggaaaacaacatcaaattaacggtagttgtgggtgacgtaattggggtcttagagcaagggaaaagaacactaacaccacagcccatggagctaaaatattcatggaaaacatggggaaaggcaaaaatagtgacagctgaaacacaaaattcctctttcataatagatgggctaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactggagagtgacatgatcatcccaaagagtctagctggtcctatttcacaacataaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacagaatgggaatgggcgttacctacttagctttaattgcaacattcaaaatccagccattcttggctttgggattcttcctgaggaagttgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagtttcacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatctttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcggctgagatggaagaagcactgaaaggactcccaataaggtatcaaacaactgcaacaaaatctgaacacacaggaagggagattgttgatctaatgtgccacgcaacattcacaatgcgcttgttatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgatgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatatacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgaccttgtgacagaaataggaagagtgccttcacacttagcctacagaacgagaaacgccctggacaacttggtgatgctgcacacatcagaacatggcggtagggcttacaggcatgcagtggaggaactaccagaaacaatggaaacactcctactcttgggactcatgatcttattaacaggtggagcaatgcttttcttgatatcaggcaaagggattggaaagacttcaataggactcatttgtgttattgtttccagtggcatgctatggatggctgatatcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagagacaacacatcatgccgtgtccagaggcagcgcaaaacttcaatggttcgtggagaggaacatggtcattcccgaaggaagggtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatacggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaacccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgtttttacagaggagaaccaatgggatagcgcgagagctgctgttgaagacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagatcactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaggaaactgcatgtctagggaaagcctacgctcaaatgtggagtctcatgtatttccacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagtcttataggcgatgaagaatttctggactacatgccttcgatgaagagattcaggaaggaggaggagtcagagggagccatttggtaa

SEQ ID NO: 7660 - RNA, 9873 nt, synthetic construct
  misc_feature 1..9873: note = derived and/or modified CDS sequence (wt) from DENV-3__EU482453__SS-prME
  source 1..9873: mol_type = other RNA
acatcgctctgcctcataatgatgttaccagcaacacttgctttccacctgacttcacgcgatggagagccgcgcatgattgtggggaagaatgaaagagggaaatccttactttttaagacagcttccggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagctaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattatcacactctatctgggagctgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgggaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctaccaatgagaaagaagagaacatggtaaagtctttagtctcagcagggagtggaaaggtggacaacttcacaatgggagtcctgtgtttggcaattctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgctacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggagcagtactgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcattgaagggactcccaataaggtatcaaacaactgcaacaaaatctgaacacacaggaagggagattgttgatctaatgtgccatgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgttagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgcttcgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttgggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagttacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagtgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagattcacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggacagcgcaagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagcctcataggcgatgaagaatttctggactacatgccttcgatgaagagattcaggaaggaggaggagttagagggagccatttggtaa

SEQ ID NO: 7661 - RNA, 9873 nt, synthetic construct
  misc_feature 1..9873: note = derived and/or modified CDS sequence (wt) from DENV-3__EU482454__SS-prME
  source 1..9873: mol_type = other RNA
acgtcactctgtctcatgatgatgttaccagcaacacttgctttccacttgacttcacgcgatggagagccgcgcatgattgtggggaagaatgaaagagggaaatccctactttttaagacagcttctggaatcaacatgtgcacactcatagctatggacttgggagaaatgtgtgatgacacggtcacttataaatgccccctcattgccgaagtggaacctgaagacattgactgctggtgcaacctcacatcgacatgggtgacttatggaacgtgcaatcaagctggggagcatagacgcgacaagagatcagtggcgttagctccccatgtcggcatgggactggatacacgtacccaaacctggatgtcggctgaaggagcttggagacaagttgaaaaggtagagacatgggctcttaggcacccaggtttcaccatactagctctatttcttgcccattacataggcacttccctgacccagaaagtggttattttcatactactaatgctggtcactccatccatgacaatgagatgcgtgggagtaggaaacagagattttgtggaaggtctgtcaggagcaacgtgggttgatgtggtgcttgagcacggtgggtgtgtgaccaccatggctaagaacaagcctacgctggacatagagcttcagaagaccgaggccactcaactggcgaccctaaggaagttatgcattgagggaaaaattaccaacataacaactgactcaaggtgtcctacccagggggaagcgactttacctgaggagcaggaccagaactacgtatgtaagcacacatacgttgatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagccacaacagagacaccaacttggaacaggaaagagcttcttgtaacattcaaaaatgcacatgcaaaaaagcaagaagtggttgtccttggatcgcaagagggagcaatgcacacagcgctgacaggagctactgagatccaaaactcaggaggaacaagcatctttgcggggcacttgaaatgtagacttaagatggacaaattggaactcaaggggatgagctatgcaatgtgcttgaatacctttgtgctgaagaaagaagtctccgaaacgcagcatgggacaatactcatcaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccaaaggtgcaaggcgcatggccatcttaggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggataggattgaattcaaaaaacacttccatgtcattttcatgcattgtgataggaattattacactctacctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggagcttgggaaaatggagtttgtggaatcaggtcaacaaccagaatggaaaatctattgtggaagcaaatagctaatgagctaaactacatattatgggaaaacaacatcaaattaacagtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcacgccgacatgggctattggatagaaagccaaaagaatggaagttggaagctagaaaaagcatccttcatagaggtaaaaacctgtacttggccaaaatcacacactctttggagcaatggtgtactagagagtgacatgatcatcccaaagagtttagctggtcctatttcacaacacaaccacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacatgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagttctatgtttggcaatcctcttcgaagaggtgatgagaggaaaatttgggaagaaacacatgattgcaggggttctctttacatttgtgctccttctctcagggcaaataacatggagagatatggcacacacactcataatgattgggtccaacgcttctgacaggatggggatgggcgttacctacttagctttaattgcaacattcaaaatccagccattcttggctttgggattcttcctgaggaaattgacatctagagaaaatttgctgttgggagttgggttggccatggcaacaacgttgcaactgccagaggacattgaacaaatggcgaatggaattgccctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggtggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgctggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagagagaaggagtcttccacactatgtggcacgtcacaagaggggcagtattgacgcacaatgggaaaagactggaaccaaactgggccagcgtgaaaaaagatctgatttcatacggaggaggatggagattgagcgcgcaatggcaaaagggagaggaggtgcaggttattgccgtagagcctgggaaaaaccccaaaaactttcaaaccatgccgggcacttttcagacaacaacgggggaaataggagcaattgcactagacttcaagcctggaacttcaggatctcctatcataaacagagagggaaaagtagtgggactgtatggcaatggagtggtcacaaaaaatggtggttacgtcagtggaatagcgcaaacaaatgcagaaccagatggaccgacaccggaattggaagaagaaatgttcaaaaagcgaaatttaaccataatggatcttcaccctgggtcagggaagacgcggaaatatcttccagccattgtcagagaagcaattaagagacgcttaagaactctaattttggcaccaacaagagtggttgcagctgagatggaagaagcactgaaaggacttccaataaggtatcaaacaactgcaacaaaatctgaacacacaggaagggagattgttgatctaatgtgccacgcaacattcacaatgcgcttgttatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaactcgggcaatgaatggattaccgactttgttgggaagacggtgtggtttgtccctagcatcaaagccggaaatgacatagcaaactgcctgcggaaaaatgggaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacctgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgttagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccctcacacttagcccacagaacgagaaacgccctggacaatttggtgatgctgcacaagtcagaacatggcggtagggcctacaggcatgcagtggaggaactaccagaaacaatggaaacactcctactcttgggactcatgatcttattaacaggtggagcaatgcttttcctgatatcaggcaaagggattggaaagacttcaatgggactcatttgtgttattgtttccagcggcatgttatggatggctgatgtcccacttcaatggatcgcgtcggctatagtcttggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaactagctatttagatgtagacttgcacccagcatcagcctggacgctgtacgccgtggccacaacagtaataacaccaatgttgagacataccatagagaattccacagcaaatgtgtccctggcagccatagctaaccaggcagtggtcctgatgggtttagacaaaggatggcctatatcgaaaatggacctaggcgtaccgctactggcactgggctgctattcacaagtgaacccactgactctcacagcagcagtacttctgctagttacacattatgccattataggtccaggactgcaggcaaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctgggaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaactccaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaaaatggttgagccatggctaaaaaacaaccagttttgcattaaagtattaaacccttacatgccaactgtgattgagcacctagaaagactacaaagaaaatatggaggaatgcttgtaagaaacccactctcacgaaactctacgcatgaaatgtactggatatccaatggtaccggcaacatcgtctcttcagtcaacatggtatccagattgctactgaacagattcacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgagctccacaaattgggtaagtgtggaagctgcgtctacaacatgatgggcaagagagagaagaaacttggagagtttggcaaagcaaaaggcagtagagctatatggtacatgtggttgggagccaggtacctcgagttcgaagcactcggatttttaaatgaagaccactggttctcacgtgaaaactcttacagtggagtagaaggagaaggactgcacaagctgggatatattttaagggacatttctaagatacccggaggagccatgtatgctgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagagaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactgataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagcccattggatccctacgagcagaacgacatggtctatccacgctcaccatcagtggatgactacagaagacatgcttactgtctggaacagggtgtggatagaggacaatccatggatggaagacaaaactccagtcacaacttgggaagatgttccatacctagggaaaagagaagatcaatggtgcggatcactcattggtctcacttccagagcaacctgggcccagaacatactcacagcaatccaacaggtgagaagcctcataggcgatgaagaatttctggactacatgccttcgatgaagagattcaggaaggaggaggagtcagagggagccatttggtaa

SEQ ID NO: 7662 - RNA, 9873 nt, synthetic construct
  misc_feature 1..9873: note = derived and/or modified CDS sequence (wt) from DENV-3__EU482455__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttacaaatgccccctcgttgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaagaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaatcaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactccccgaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaactgacatctagagaaaatttgttgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcactctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaataatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaattgagacctaggtggcttgatgcccgcacttattcagatcccttagcacttaaggaattcaaggattttgcagctggcagaaagtcaatcgcctttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggtatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactagcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaataggaaggagaggaacggggtcacaaggcgaaaccttgggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggttgtggaagaggaggctggtcatattattgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtgccagtccattggatccctacaagcagaacgacatggtctattcacgctcaccatcagtggatgaccacagaagacatgctaactgtctggaacagggtgtggatagaggacaatccatggatggaagacaaaactccagttacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 7663 - RNA, 9873 nt, synthetic construct
  misc_feature 1..9873: note = derived and/or modified CDS sequence (wt) from DENV-3__EU482456__SS-prME
  source 1..9873: mol_type = other RNA
acatcgctctgcctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcagctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgttatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcactgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcgaaaaagcaagaagtggttgtccttggatcgcaagagggagcaatgcacacagcgctgacaggagccacagagattcaaaactcaggaggtacaagcatctttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagcggagtctcatggataatgaaaattggaataggtgtcctcttaacctggatagggttgaattcaaaaaatacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacacaattggggtcttagagcaagggaaaagaacattaacaccacagcctatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaaactagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctatgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaatgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacataccagttgtggacggcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccgctgtttatcttcagcttgaaggacacaccaaaaaggaggagctggccactgaatgagggagtgatggctgttgggcttgtgagcattctagctagctctctccttaggaatgatgtgcccatggctggaccactagtggccgggggcttgttgatagcgtgctatgtcataactggcacgtcagcagacctcactgtagaaaaggcagcagacgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatatggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagtaacgctccaattcaagatgaagaaagggatattccggaacgctcatggaattcaggtaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccagactgaatgactgggacttcgtggtgacaacagacatttcagaaatgggagctaactttaaagcagatagagtgattgacccaagaagatgtctcaagccagtaattttgacagatggacccgagcgagtgatcctggctggaccaatgcctgtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgttgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattctagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatatgtgttattgtttccagtggcatgttatggatggctgatgtcccactccaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaaccacaaagagagacttaggaatgtctaaagaaccaggtgttgtttctccaaccagctatttagatgtagacttgcacccagcatcagcctggacattgtatgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctattggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggacagaacagaagccaaagaagggttgaaaagaggagaaacaacacatcatgccgtgtccagaggcagcgcaaaacttcaatggttcgtggagaggaacatggtcattcccgaaggaagagtcatagacctaggctgtggaagaggaggctggtcatattactgtgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccctacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcaccaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctataatatgatgggcaagagagagaagaaacttggagagtttggtaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagcttacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaatcctcatctgctagagaagaaaatcacacaatggttggaaaccaaaggagtggagagattaaaaagaatggccatcagcggagatgattgcgtggtgaaaccgattgatgacaggtttgccaacgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggataatccatggatggaagacaaaactccagtcacaacttgggaagatgttccatacctagggaagagagaagatcaatggtgcggatcactcattggtctcacttccagagcaacctgggcccagaacatactcacggcaatccaacaggtgaggagccttataggcgatgaagaatttctggactacatgccttcaatgaagagattcaggaaggaggaggagtcagagggagccatttggtaa

SEQ ID NO: 7664 - RNA, 9873 nt, synthetic construct
  misc_feature 1..9873: note = derived and/or modified CDS sequence (wt) from DENV-3__EU482457__SS-prME
  source 1..9873: mol_type = other RNA
acatcgttctgtctcatgatgatgttaccagcaacacttgccttccacttgacttcacgcgatggagagccgcgcatgatagtggggaagaatgaaagagggaaatccctactttttaagacagcttctggaatcaacatgtgcacactcatagctatggacttgggagagatgtgtgatgacacggtcacttataaatgccccctcattgccgaagtggaacctgaagacattgactgctggtgcaaccttacatcgacatgggtgacttatggaacgtgcaatcaagctggggagcatagacgcgacaagagatcagtggcgttagctccccatgtcggcatgggactggacacacgtacccaaacctggatgtcggctgaaggagcttggagacaagttgaaaaggtagagacatgggctcttaggcacccaggttttaccatactagctctatttctagcccattacataggcacttccctgacccagaaagtggttatttttatactactaatgctggtcactccatccatgacaatgagatgcgtgggggtaggaaacagagattttgtggaaggtctgtcaggagctacgtgggttgacgtggtgctcgagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcccacccagggggaagcgactttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaatccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagccacagagattcaaaactcaggaggtacaagcatttttgcggggcacttgaaatgtagacttaagatggacagattggaactcaaggggatgagctatgcaatgtgtttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacatcgaggctgaacctccttttggggaaagcaacatagtgattggaattggagacaaagccttgaaaattaattggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcagatcaacaaccagaatggagaatctattgtggaagcaaatagccaatgagctgaactacatattatgggaaaacaacatcaaattaacggtagttgtgggcgacacaattggggtcttagagcaagggaaaagaacactaacaccacaacccatggagctaaaatattcatggaaaacatggggaaaggcaaaaatagtgacagctgaaacacaaaattcctctttcataatagatggtccaaacacaccggagtgtccaagcgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagttagaaaaagcatcctttatagaggtgaaaacctgtacttggccaaaatcacatactctttggagcaatggtgtactagagagtgacatgatcatcccaaagagtttagctggtcctatctcacaacacaaccacaggcctgggtaccacacccaaacggcaggaccttggcacttgggaaaattggagctggacttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacataccctcataatgattgggtctaacgcttccgacaggatggggatgggcgttacctacttggctttaattgctacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaatacaattttcacgttgactgttgcctggagaacagccaccttgattctggccggagtttcgcttttgccactgtgccagtcttcgagcatgaggaaaacagattggctcccaatgaccgtggcagctatgggagttccacccttaccactttttatcttcagcttgaaggacacacccaaaaggaggagctggccactgaatgagggagtgatggctgttgggcttgtgagcattctggctagttctctcctcaggaatgatgtgcccatggctggaccactagtggccgggggcttgttgatagcgtgctatgtcataactggcacgtcagctgacctcactgtagaaaaagcagcagatgtaacatgggaggaagaggctgagcaaacaggagtgtcccacaatttgatggtcacagttgatgatgatggaacaatgagaataaaggatgatgagactgagaacatcctaacagtgctcttaaaaacagcactactaatagtatcaggcatctttccatactccatacccgccacactgttggtctggcatacttggcaaaagcaaacccaaagatctggcgttctatgggacgtacccagccccccagaaacacagaaagcagaattggaagagggggtctataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccagaattggaagaagaaatgttcaaaaagcgaaatctaaccataatggatcttcatcctgggtcaggaaagacgcggaaatatcttccagccatcgttagagaagcaatcaagagacgcttaagaactctaatcttggcaccaacaagagtggttgcagctgagatggaagaagcactgaaaggactcccaataaggtaccaaacaactgcaacaaaatctgaacacacaggaagggaaattgttgatctaatgtgccacgcaacattcacaatgcgcttgctatcaccagtcagggttccaaattacaatttgataataatggatgaggcccatttcacagatccagccagtatagcggctagagggtatatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccacgctcactggacagaagcaaaaatgctgctagacaacatcaacacaccagaagggatcataccagctctctttggaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagataggaaatggtgctttgatggagaacgtaacaatcaaattttagaggagaacatggatgtggaaatctggacaaaggaaggagaaaggaaaaaattgagacctaggtggcttgatgcccgcacttattcagatcccttagcactcaaggaatttaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtggaggaactaccagaaacaatggaaacactcctactcttgggactcatgatcttgttaacaggtggagcaatgcttttcttgatatcaggcaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtctctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccatcataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagccgtttccatggctaacatctttagagggagctacctagctggagctgggcttgctttttctatcatgaaatcagttggaacaggaaggagaggaacggggtcacaaggcgaaaccttaggagaaaagtggaaaaagaaactaaatcagttatcccggaaagagtttgacctttacaagaaatctggaatcactgaagtggacagaacagaagccaaagaagggttgaaaagaggagaaacaacacatcatgccgtgtccagaggcagcgcaaaacttcaatggttcgtggagaggaacatggtcattcccgaaggaagagtcatagacttgggctgtggaagaggaggctggtcatattactgcgcaggactgaaaaaagttacagaagtgcgaggatacacaaaaggcggcccaggacacgaagaaccagtacccatgtctacatacggatggaacatagtcaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgtattaaagtattaaacccctacatgccaactgtgattgagcacctagaaagactacaaagaaaatatggaggaatgcttgtgagaaacccactctcacgaaactccacgcatgaaatgtactggatatccaatggcaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagttaaagccacaggctcagcctcctccatgataaatggagtcgtgaaactcctcacaaagccatgggatgtggttcccatggtgacacagatggcaatgacagatacaactccatttggacagcaaagagttttcaaggagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggaaaaccaatgggataatgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagcagagctatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgctgatgacacagctggttgggacacaagaataacagaagatgacctgcacaatgaggaaaaaatcacacagcaaatggaccctgaacacagacaattggcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaggtccctttttgctcccaccactttcatgagctgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatatctaggaaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagtcagagggagccatttggtaa

SEQ ID NO: 7665 - RNA, 9873 nt, synthetic construct
  misc_feature 1..9873: note = derived and/or modified CDS sequence (wt) from DENV-3__EU482458__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggttttaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttacaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccataggcctgggtaccacacccaaacggcaggaccttggcacttgggaaaattggagctggactttaactattgtgaaggaacaacagtagtcatcacagaaaactgtgggatgagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccaaagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaaaggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagccggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaaccccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattacgccattataggtccaggattgcaggctaaagccactcgtgaagctcaaaaaagaacagctgctggaataatgaagaatccaacggtagatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaataaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagcggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccaatcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7666 - RNA, 9873 nt, synthetic construct
  misc_feature 1..9873: note = derived and/or modified CDS sequence (wt) from DENV-3__EU482459__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagccgacgctggacatagagcttcagaagaccgaggccacccaactggcgaccctaaggaagttatgcattgagggaaaaattaccaacataacaactgattcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctaacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggtgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7667 - RNA, 9873 nt, synthetic construct
  misc_feature 1..9873: note = derived and/or modified CDS sequence (wt) from DENV-3__EU482460__SS-prME
  source 1..9873: mol_type = other RNA
acatcgctctgcctcatgatgatgttaccagcaacatttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttacaaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcttggatggtacataggcaatggttctttgacctacccctaccatggacatcaggaactacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacctgaaatgtagacttaagatggacaaattggaactcaaggggatgagctatgcaatgtgcttgaacacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacagatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagagcattagcaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagtcgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgttataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcacacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcataatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaatgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacctgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgatccaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcggtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggattaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaaccccatttgggcagcaaagagttttcaaagagaaagtggacaccaggacacccaggcccatgccagggacaagaaaggttatggagatcacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaactcggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttagaaaccaaaggagtggagagattgaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7668 - RNA, 9873 nt, synthetic construct
  misc_feature 1..9873: note = derived and/or modified CDS sequence (wt) from DENV-3__EU482461__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagtgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctggtaataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtaattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7669 - RNA, 9873 nt, synthetic construct
  misc_feature 1..9873: note = derived and/or modified CDS sequence (wt) from DENV-3__EU482462__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaggaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcattatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacggaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactgacaccacagcccatggacctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggaaagatatggcacacacattcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttggttctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacctgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctattataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcaccctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagcatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggttatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaactagctatttggatgtagacttgcacccagcatcagcctggacactgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagatttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccttattgtgtgacattggagaatcttcaccaagcccaacagtggaagaaagcagaactataagagtcttgaagatggttgagccatggctgaaaaacaaccagttttgtattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaggccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattaggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagcggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcacgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccataagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatctggtaa

SEQ ID NO: 7670 - RNA, 9873 nt, synthetic construct
  misc_feature 1..9873: note = derived and/or modified CDS sequence (wt) from DENV-3__EU660407__SS-prME
  source 1..9873: mol_type = other RNA
acatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgtatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagaatgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaatgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagtgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccaacaccggaattggaagaagaaatgttcaaaaagcgaaatttaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatggaaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaagagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgcgtggtgaaaccgattgatgacaggttcgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7671 - RNA, 9873 nt, synthetic construct
  misc_feature 1..9873: note = derived and/or modified CDS sequence (wt) from DENV-3__EU660409__SS-prME
  source 1..9873: mol_type = other RNA
acatcgctctgcctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctagtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccgactggcgaccctaaggaagttatgcattgagggaaaaattaccaacataacaactgactcaaggtgtcccacccagggggaagcgattctacctgaggagcaggaccagaactacgtatgtaagcacacatacgtggatagaggttggggaaacggttgtggcttgtttggaaaaggaagcttggtgacatgcgcgaaatttcaatgtctagaactaatagagggaaaagtggtgcaatatgagaaccttaaatacactgtcatcatcacagtgcacacaggagaccaacaccaagtgggaaatgacacgcagggagccacggttgagataacaccccaggcatcaaccgttgaagccgtcttgcctgagtatggaacccttgggctagaatgctcgccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtgacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgcgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctaaactacatattatgggaaaacaacatcaaattaacggtagttgtgggtgacataattggggtcttagagcaagggaaaagaacgctaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggctgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaaggggcccatcattgagaacaacaacagtgtcagggaagctgatacacgaatggtgttgccgctcgtgcacacttcctcccttacgatacatgggagaggacggctgctggtatggtatggaaattagacctatcaatgagaaagaagagaacatggtaaagtctttagtctcagcagggagtggaaaggtggacaacttcacaatgggagccctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacagaatgggaatgggcgttacctacttagctttaattgcaacattcaaaatccagccattcttggctttgggattcttcctgaggaaattgacatccagagaaaatttgctgttgggagttgggttggccatggcaacaacgttacaactgccagaggacattgaacagatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatggctgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggtagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatctttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacatttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcttacagaacgagaaacgccctggacaacttggtgatgttgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttactgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtcttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtttacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtccaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaaggaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagtcttataggcgatgaagaatttctggactacatgccttcgatgaagagattcaggaaggaggaggagtcagagggagccatttggtaa

SEQ ID NO: 7672 - RNA, 9873 nt, synthetic construct
  misc_feature 1..9873: note = derived and/or modified CDS sequence (wt) from DENV-3__EU660410__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaggaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcattatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacggaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagactacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctattaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacattcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccactttggttctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacctgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctattataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcaccctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagcatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggttatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgcaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaactagctatttagatgtagacttgcacccagcatcagcctggacactgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgcaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacaccatgccgtgtccagaggcagcgcaaaacttcaatggttcgtggagaggaacatggtcattcccgaaggaagagtcatagatttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccttattgtgtgacattggagaatcttcaccaagcccaacagtggaagaaagcagaactataagagtcttgaagatggttgagccatggctgaaaaacaaccagttttgtattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaggccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccaggaacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattaggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcacgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccataagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatctggtaa

SEQ ID NO: 7673 - RNA, 9873 nt, synthetic construct
  misc_feature 1..9873: note = derived and/or modified CDS sequence (wt) from DENV-3__EU660411__SS-prME
  source 1..9873: mol_type = other RNA
acatcgctctgcctcatgatgatgttaccagcaacacttgctttccacttgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgcacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaaaaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaacgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatctttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctcttttataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcattacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacttatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttacaggatcaaacaacaaggaatttttggaaaaacccaagtgggggttggagtgcagaaagaaggagtcttccacaccatgtggcacgtcacaagaggggcagtattgacgcacaatgggaaaagactggaaccaaactgggccagtgtgaaaaaagatctgatttcatacggaggaggatggagattgagtgcacaatggcaaaaaggagaggaggtgcaggttattgctgtggagcctgggaagaacccaaaaaacttccaaaccatgccgggcatttttcagacaacaacgggggaaataggagcaattgcactagacttcaagcctggaacttcaggatctcctatcataaacagagagggaaagatagtgggactgtatggcaatggagtggttacgaaaaatggtggctacgtcagtggaatagcgcaaacaaatgcagaaccagacggaccgacaccggaattggaagaggaaatgttcaaaaagcgaaatctaaccataatggatcttcatcctgggtcaggaaagacgcggaaatatcttccagccatcgtcagagaagcaatcaagagacgtttgagaactctaattttggcaccaacaagagtggttgcagctgagatggaagaagcactgaaaggactcccaataaggtatcaaacaactgcaataaaatctgaacacacaggaagggagattgttgatctaatgtgccacgcaacattcacaatgcgcttgctatcaccagtcagggttccaaattacaatttgataataatggatgaggcccacttcacagatccagccagtatagcggctagagggtacatatcaactcgtgtaggaatgggagaggcagctgcaatcttcatgacagcaacaccccctggaactgctgaagcctttcctcagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagctaactttaaagcagatagagtgattgacccaagacgatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcgaatgtatccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaactgtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctattatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaatatagtcaaactaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcaagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctactagagaagaaaatcacacaatggttggaaaccaaaggagtggagagattaaaaagaatggccatcagcggagatgattgcgtggtaaaaccgattgatgacaggtttgccaatgccctgcttgctctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7674 - RNA, 9873 nt, synthetic construct
  misc_feature 1..9873: note = derived and/or modified CDS sequence (wt) from DENV-3__FJ432722__SS-prME
  source 1..9873: mol_type = other RNA
acatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtaacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtgggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcctgcctgagtatggaacccttgggctagaatgctcaccacggacaggcttggatttcaatgaaatgattttattgacaatgaaaaacaaagcctggatggtacataggcaatggttctttgacctacctctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgttgacaggagctacagagattcaaaactcaggaggtacaagcatttttgcggggcacttgaaatgcagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctacgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaggtgggggttggagtgcagaaagaaggagtcttccacaccatgtggcacgtcacaagaggggcagtattgacgcacaatgggaaaagactggaaccaaactgggccagtgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccaacaccggaattggaagaagaaatgttcaaaaagcgaaatttaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattacagactttgttggaaagacggtgtggtttgtacctagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctagaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggtgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacttagaaagattacaaagaaagtatggaggaatgcttgtgagaaacccactctcacgaaactccacgcatgaaatgtactggatatccaatggtactggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgagaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaatacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgcgtggtgaaaccgattgatgacaggttcgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagtcatttggtaa

SEQ ID NO: 7675 - RNA, 9873 nt, synthetic construct
  misc_feature 1..9873: note = derived and/or modified CDS sequence (wt) from DENV-3__FJ432728__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagataaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattgaacccttacatgccaactgtaattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7676 - RNA, 9873 nt, synthetic construct
  misc_feature 1..9873: note = derived and/or modified CDS sequence (wt) from DENV-3__FJ432731__SS-prME
  source 1..9873: mol_type = other RNA
acatcgctctgcctcatgatgatgttaccagcaacacttgctttccatctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcatgtttgtgctccttctctcagggcaaataacatggagagatatggcacagacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatgacaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgcttttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacccaggtggcttgatgcccgcacttattcagatcccttagcactcaaggaattcaaggattttgcagctggcagaaagtcaatcgcccttgatcttgtgacagaaataggaagagtgccttcacatttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcttgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagccgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacataggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagggttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaactaggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggatatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttttgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7677 - RNA, 9873 nt, synthetic construct
  misc_feature 1..9873: note = derived and/or modified CDS sequence (wt) from DENV-3__FJ562097__SS-prME
  source 1..9873: mol_type = other RNA
acatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggtcatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgccctacccagggggaagcgattctacctgaggagcaggaccagaactacgtgtgtaagcatacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactggagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcatgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcagcaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtagcagctatgggagttccacccttaccactttttatcttcagcttgaaggacacaccaaaaaggaggagctggccactgaatgagggggtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcgtctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagtgtgaaaaaagatctgatttcatacggaggaggatggagattgagcgcacaatggcaaaaaggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggttacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagatcgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccccggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagacagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgttgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggatctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttgtcccggaaagagtttgacctttacaagaaatctggaattactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgtgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctactaaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaaccgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7678 - RNA, 9873 nt, synthetic construct
  misc_feature 1..9873: note = derived and/or modified CDS sequence (wt) from DENV-3__FJ432741__SS-prME
  source 1..9873: mol_type = other RNA
acatcgctctgcctcatgatgatgttaccagcaacacttgctttccacctgacttcacgcgatggagaaccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtggccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaatacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgcacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatggtcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaagtgttcaaaaagcgaaatctaaccataatggatcttcatcctgggtcaggaaagacgcggaaataccttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgatcgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctgctcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattactactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtaaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacctatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7679 - RNA, 9873 nt, synthetic construct
  misc_feature 1..9873: note = derived and/or modified CDS sequence (wt) from DENV-3__FJ562099__SS-prME
  source 1..9873: mol_type = other RNA
acatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgccctacccagggggaagcgattctacctgaggagcaggaccagaactacgtgtgtaagcatacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcatgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtagcagctatgggagttccacccttaccactttttatcttcagcttgaaggacacaccaaaaaggaggagctggccactgaatgagggggtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcgtctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagtgtgaaaaaagatctgatttcatacggaggaggatggagattgagcgcacaatggcaaaaaggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccccggaactgctgaagcctttccccagagcaacgctccaattcaagatgaagaaagggatattccggaacgctcatggaattcaggcaatgaatggattaccgactttgttggaaagacggtgtggtttgtacccagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccggtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagacagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggatctaggcgtaccgctactggcactaggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttgtcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgtgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctgctgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctctatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacatttaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgtgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaaccgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7680 - RNA, 9873 nt, synthetic construct
  misc_feature 1..9873: note = derived and/or modified CDS sequence (wt) from DENV-3__KF955457__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagccacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaatttctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagctatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagataaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggataggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattgaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7681 - RNA, 9873 nt, synthetic construct
  misc_feature 1..9873: note = derived and/or modified CDS sequence (wt) from DENV-3__FJ562100__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtggatgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccatcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgttcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttacagtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7682 - RNA, 9873 nt, synthetic construct
  misc_feature 1..9873: note = derived and/or modified CDS sequence (wt) from DENV-3__FJ547062__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttgctttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataagcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccatcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggccttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttatagtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7683 - RNA, 9873 nt, synthetic construct
  misc_feature 1..9873: note = derived and/or modified CDS sequence (wt) from DENV-3__FJ461322__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgttggacatagagcttcagaagaccgaggccacccaactggcgaccctaaggaagttatgcattgagggaaaaattaccaacataacaactgactcaaggtgtcctacccagggggaagcgattctacctgaagagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacttttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggagagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcgtgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtctttacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacatacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcaattgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagttagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaatgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatggaaaaaaggtcatccaacttagcagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgaggtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgtcgtttctccaaccagctatttagatgtagacttgcacccagcatcagcctggacattgtacgctgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttggcaggagctgggcttgctttttctatcatgaaatcagttggaacaggaaggagaggaacggggtcacaaggcgaaaccttgggagaaaagtggaaaaagaaattaaatcagttatcccggaaagagtttgatctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacatagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagttttaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaatatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatattccatacctagggaagagagaagatcaatggtgcggatcactcattggtctcacctccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7684 - RNA, 9873 nt, synthetic construct
  misc_feature 1..9873: note = derived and/or modified CDS sequence (wt) from DENV-3__KF955458__SS-prME
  source 1..9873: mol_type = other RNA
acatcgctctgcctcatgatgatgttaccagcaacacttgctttccatctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccaaggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcagtatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcctgaatacctttgtgttgaagaaagaagtctctgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgaacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaagaaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacctgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaacctgaccataatggatcttcatcctgggtcaggaaagacgcggaaataccttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgacacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttgatgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacactgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacggcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaggtgcgaggatacacaaaaggtggcccaggacacgaagaaccagtacccatgtccacatacggatggaacctagtcaagctaatgagtggaaaggacgtgttttatcttccacctgagaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatgggagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaaccccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7685 - RNA, 9873 nt, synthetic construct
  misc_feature 1..9873: note = derived and/or modified CDS sequence (wt) from DENV-3__FJ562102__SS-prME
  source 1..9873: mol_type = other RNA
acatcgctctgcctcatgatgatgttaccagcaacacttgctttccacctgacttcacgcgatggagaaccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacattcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtaataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccgctgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtgcctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaagtgagaagccttataggcgatgaagaatttctggactacatgccttcgatgaagagattcaggaaggaggaggagtcagagggagccatttggtaa

SEQ ID NO: 7686 - RNA, 9873 nt, synthetic construct
  misc_feature 1..9873: note = derived and/or modified CDS sequence (wt) from DENV-3__FJ410229__SS-prME
  source 1..9873: mol_type = other RNA
acatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagatattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctatgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagagatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggccatgggagctgttttcacagaggagaaccaatgggatagcgcgagagctgctgttgaggacgaagaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 7687 - RNA, 9873 nt, synthetic construct
  misc_feature 1..9873: note = derived and/or modified CDS sequence (wt) from DENV-3__FJ461326__SS-prME
  source 1..9873: mol_type = other RNA
acatcgctctgcctcatgatgatgttaccagcaacacttgctttccacctgacttcacgcgatggagaaccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataagcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaggaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggctggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagacctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcattcaacttagtagaaagacttttgatacagaataccaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgcgttattgcttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcatcaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagaaaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaacagcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa
